(12) United States Patent
Suri et al.

(10) Patent No.: US 9,475,879 B2
(45) Date of Patent: Oct. 25, 2016

(54) ANTIBODY POLYPEPTIDES THAT ANTAGONIZE CD40

(75) Inventors: Anish Suri, Yardley, PA (US); Steven Sheriff, Princeton, NJ (US); Suzanne Suchard, Wilmington, DE (US); Aaron Yamniuk, Lawrenceville, NJ (US); Stanley Krystek, Ringoes, NJ (US); James Tamura, Yardley, PA (US); James Bryson, Langhorne, PA (US); Steven Grant, Swaffham Prior (GB); Philip Drew, Histon (GB)

(73) Assignees: BRISTOL-MYERS SQUIBB COMPANY, Princeton, NJ (US); DOMANTIS LIMITED, Brentford, Middlesex (GB)

( * ) Notice: Subject to any disclaimer, the term of this patent is extended or adjusted under 35 U.S.C. 154(b) by 326 days.

(21) Appl. No.: 14/112,049

(22) PCT Filed: Apr. 20, 2012

(86) PCT No.: PCT/US2012/034519
§ 371 (c)(1),
(2), (4) Date: Dec. 18, 2013

(87) PCT Pub. No.: WO2012/145673
PCT Pub. Date: Oct. 26, 2012

(65) Prior Publication Data
US 2014/0099317 A1 Apr. 10, 2014

Related U.S. Application Data

(60) Provisional application No. 61/477,904, filed on Apr. 21, 2011.

(51) Int. Cl.
*A61K 39/395* (2006.01)
*C07K 16/28* (2006.01)

(52) U.S. Cl.
CPC ....... *C07K 16/2878* (2013.01); *C07K 2317/34* (2013.01); *C07K 2317/569* (2013.01); *C07K 2317/76* (2013.01)

(58) Field of Classification Search
None
See application file for complete search history.

(56) References Cited

U.S. PATENT DOCUMENTS

| | | |
|---|---|---|
| 5,182,368 A | 1/1993 | Ledbetter et al. |
| 5,247,069 A | 9/1993 | Ledbetter et al. |
| 5,674,492 A | 10/1997 | Armitage et al. |
| 5,677,165 A | 10/1997 | de Boer et al. |
| 5,786,456 A | 7/1998 | Ledbetter et al. |
| 5,849,898 A | 12/1998 | Seed et al. |
| 5,916,560 A | 6/1999 | Larsen et al. |
| 6,051,228 A | 4/2000 | Aruffo et al. |
| 6,056,959 A | 5/2000 | de Boer et al. |
| 6,376,459 B1 | 4/2002 | Aruffo et al. |
| 2006/0062784 A1 | 3/2006 | Grant et al. |

FOREIGN PATENT DOCUMENTS

| | | |
|---|---|---|
| CN | 1922316 A | 2/2007 |
| CN | 101061140 A | 10/2007 |
| EP | 1 707 627 A1 | 10/2006 |
| EP | 2255828 A1 | 12/2010 |
| KR | 10-2006-0130615 A | 12/2006 |
| WO | WO-99/20749 A1 | 4/1999 |
| WO | WO-02/28481 A2 | 4/2002 |
| WO | WO-2005/044294 A2 | 5/2005 |
| WO | WO-2005/093074 A1 | 10/2005 |
| WO | WO-2006030220 A1 | 3/2006 |
| WO | WO-2007/085815 A2 | 8/2007 |
| WO | WO-2008/149143 A2 | 12/2008 |

OTHER PUBLICATIONS

Written Opinion of the International Searching Authority of PCT/US2012034519 (Oct. 21, 2013).*
Rudikoff et al., Proc Natl Acad Sci USA 79: 1979-1983 (1982).*
Colman, Research in Immunology 145: 33-36 (1994).*
Kussie et al., J. Immunol. 152: 146-152 (1994).*
Chen et al., EMBO J., 14: 2784-2794 (1995).*
Chinese counterpart Patent Application No. 201280030683.4, Office Action dated Nov. 16, 2015 (partial English translation/characterization).
Korean counterpart Patent Application No. 10-2013-7030492, Office Action dated Nov. 26, 2015 (with partial English translation/characterization).
New Zealand counterpart Patent Application No. 712771, Office Action dated Oct. 16, 2015.
Taiwanese Applications No. 101114258, partial English translation/characterization of Office Action dated Nov. 24, 2015.
An et al., 2011, "Crystallographic and mutational analysis of the CD40-CD154 complex and its implications for receptor activation," J Biol Chem. 286(13):11226-35.
International Preliminary Report on Patentability mailed on Oct. 31, 2013 for PCT/US2012/034519 filed on Apr. 20, 2012.
Office Action dated Jul. 14, 2014 in New Zealand counterpart Patent Application No. 618025.
English translation of Office Action and Search Report dated Mar. 10, 2015 in Chinese counterpart Patent Application No. 201280030683.4.
English translation of Office Action dated Mar. 10, 2015 in Colombian counterpart Patent Application No. 13.261.140.
English translation of Office Action dated Apr. 28, 2015 in Korean counterpart Patent Application No. 10-2013-7030492.

(Continued)

*Primary Examiner* — Phillip Gambel
(74) *Attorney, Agent, or Firm* — Drinker Biddle & Reath LLP

(57) ABSTRACT

Antibody polypeptides that specifically bind a novel epitope of human CD40 are provided. The antibody polypeptides do not exhibit CD40 agonist activity. The antibody polypeptides are useful in the treatment of diseases involving CD40 activation, such as autoimmune diseases. The antibody polypeptides may be domain antibodies (dAbs) comprising a single $V_L$ or $V_H$ domain. The half-life of the antibody polypeptides may be increased by modifying the antibody polypeptides to be dual specific reagents that can also bind human serum albumin (HSA).

15 Claims, 7 Drawing Sheets

(56) References Cited

OTHER PUBLICATIONS

"Study of HCD122 (Lucatumumab) and Bendamustine Combination Therapy in CD40+ Rituximab-Refractory Follicular Lymphoma," Clinical Trials, Jan. 10, 2012 [online]. [retrieved on Jun. 30, 2015]. Retrieved from the Internet <URL:http://clinicaltrials.gov/show/NCT01275209>.
Adams, et al., "Development of a chimeric anti-CD40 monoclonal antibody that synergizes with LEA29Y to prolong islet allograft survival," *J. Immunol.* 174: 542-50 (2005).
Arkin et al., "An algorithm for protein engineering: Simulations of recursive ensemble mutagenesis", *Proc. Nat'l Acad. Sci. USA* 89:7811-7815 (1992).
Brand et al., "The Mouse Model of Collagen-Induced Arthritis", in *Methods Mol. Med.*, vol. 102, Humana Press Inc., Totowa New Jersey, pp. 295-312 (2004).
Blanc et al., "Refinement of severly incomplete structures with maximum likelihood in BUSTER-TNT", *Acta Cryst.* D60: 2210-2221 (2004).
Chapman, et al., "PEGylated antibodies and antibody fragments for improved therapy: a review," *Adv. Drug Deliv. Rev.* 54(4):531-45 (2002).
Connolly, "Analytical Molecular Surface Calculation", *J. Appl. Crystallogr.* 16: 548-558 (1983).
Davies et al., "TRAF6 is Required for TRAF2-Dependent CD40 Signal Transduction in Nonhemopoietic Cells", *Mol. Cell Biol.* 25: 9806-19 (2005).
de Kruif et al., "Rapid selection of cell subpopulation-specific human monoclonal antibodies from a synthetic phage antibody library", *Proc. Natl. Acad. Sci. USA* 92: 3938 (1995).
De Winter et al., "Mucosal immunity and inflammation. II. The yin and yang of T cells in intestinal inflammation: pathogenic and protective roles in a mouse colitis model", *Am. J. Physiol.* 276: G1317-1321 (1999).
Emsley et al., "*Coot*: model-building tools for molecular graphics", *Acta Cryst.* D60: 2126-2132 (2004).
Emsley et al., "Features and Development of *Coot*," *Acta Cryst.* D66: 486-501 (2010).
Harrison et al., "Screening of Phage Antibody Libraries", *Meth. Enzymol.* 267: 83-109 (1996).
Hoogenboom et al., "Multi-subunit proteins on the surface of filamentous phage: methodologies for displaying antibody (Fab) heave and light chains", *Nucleic Acid Res.* 19:4133-4137 (1991).
Kouskoff et al., "Organ-specific disease provoked by systemic autoimmunity", *Cell* 87: 811-822 (1996).
Lawrence et al., "Shape Complementarity at Protein/Protein Interfaces," *J. Mol. Biol.* 234: 946-950 (1993).
Marks et al., "Human antibody fragments specific for human blood group antigens from a phage display library", *BioTechnology* 11: 1145-1149 (1993).
McCoy et al., "*Phaser* crystallographic software", *J. Appl. Crystallogr.* 40: 658-674 (2007).
Pape et al., "Use of adoptive transfer of T-cell-antigen-receptor-transgenic T cell for the study of T-cell activation in vivo", *Immunol. Rev.* 156: 67-78 (1997).
Sheriff et al., "Structure of myohemerythrin in the azidomet state at 1.7/1.3 A resolution", *J. Mol. Biol.* 197: 273-296 (1987).
Sheriff, "Some methods for examining the interactions between two molecules", *Immunomethods* 3: 191-196 (1993).
Tronrud et al., "An efficient general-purpose least-squares refinement program for macromolecular structures", *Acta Cryst.* A43: 489-501 (1987).
Office Action dated Jun. 2, 2015 in Australian counterpart Patent Application No. 2009270726.
An et al., "Crystallographic and Mutational Analysis of the CD40-CD154 Complex and its Implications for Receptor Activation", The Journal of Biological Chemistry, vol. 286, No. 13, pp. 11226-11235 (Apr. 1, 2011).
Australian Patent Application No. 2012245309 Office Action dated Jun. 2, 2015.
Chilean Patent Application No. 03043-2013 Opposition filed Oct. 10, 2014 (with partial English translation/characterization.
European Patent Application No. 12717027.2 Office Action dated Jul. 29, 2015.
Eurasian Patent Application No. 201391564 Office Action dated May 29, 2015 (with partial English translation/characterization).
New Zealand Patent Application No. 618025 Office Action dated Sep. 4, 2015.
A.-C. Malmborg Hager, et al., "Affinity and Epitope Profiling of Mouse Anti-CD40 Monoclonal Antibodies," Scandinavian Journal of Immunology, 2003, 57, pp. 517-524.
Y. Zhuang, et al., "A novel blocking monoclonal antibody recognizing a distinct epitope of human CD40 molecule," Tissue Antigens, 2005, 65, pp. 81-87.
International Search Report mailed on Jun. 15, 2012 for PCT/US2012/034519 filed on Apr. 20, 2012.
Qatar Patent Application No. QA/201310/00242, partial English translation/characterization of Office Action dated Sep. 7, 2015.
Thailand Patent Application No. 1301006018, partial English translation/characterization of Office Action dated Sep. 29, 2015.
Japanese Application No. 2014-506589, Office Action dated Feb. 9, 2016 (with partial English translation).
Chilean Application No. 03043-2013, Office Action dated Mar. 27, 2016 (with partial English translation/characterization).
Eurasian Application No. 201391564, Office Action dated Apr. 26, 2016 (with partial English translation/characterization).
Israeli Application No. 228720, Office Action dated Apr. 19, 2016 (with partial English translation/characterization).

\* cited by examiner

```
                              CDR1                                    CDR2
BMS3h-37-207   EVQLLESGGGLVQPGGSLRLSCAASGFTFEWYEMQWVRRAPGKGLEWVSAISGDGYRTYY  60
BMS3h-37-213   EVQLLESGGGLVQPGGSLRLSCAASGFTFEWYEMQWVRRAPGKGLEWVSAISGDGYRTYY  60
BMS3h-37-212   EVQLLESGGGLVRPGGSLRLSCAASGFTFEWYEMQWVRRAPGKGLEWVSAISGDGYRTYY  60
BMS3h-37-205   EVQLLESGGGLVQPGGSLRLSCAASGFTFEWYEMQWVRRAPGKGLEWVSAISGDGYRTYY  60
BMS3h-37-206   EVQLLESGGGLVQPGGSLRLSCAASGFTFEWYEMQWVRRAPGKGLEWVSAISGDGYRTYY  60
               ************ *********************************************

CDR2                                  CDR3
BMS3h-37-207   ADSVKGRFTISRDNSKNTLYLQMNSLRAEDTAVYYCAKELAFFDYWGRGTLVTVSS 116  (SEQ ID NO: 226)
BMS3h-37-213   ADSVKGRFTISRDNSKNTLYLQMNSLRAEDTAVYYCAKELLFFDYRGRGTLVTVSS 116  (SEQ ID NO: 232)
BMS3h-37-212   ADSVKGRFTISRDNSKNTLYLQMNSLRAEDTAVYYCAKELEFFDYWGRGTLVTVSS 116  (SEQ ID NO: 231)
BMS3h-37-205   ADSVKGRFTISRDNSKNTLYLQMNSLRAEDTAVYYCAKELEYFDYWGRGTLVTVSS 116  (SEQ ID NO: 224)
BMS3h-37-206   ADSVKGRFTISRDNSKNTLYLQMNSLRAEDTAVYYCAKGLEYFDYWGRGTLVTVSS 116  (SEQ ID NO: 225)
               ************************************ *** ***************
```

FIG. 6

|              | CDR1                                                          | CDR2                                                        |    |
|--------------|---------------------------------------------------------------|-------------------------------------------------------------|----|
| BMS3h-38-217 | EVQLLASGGGLVQPGGSLRLSCAASGFTFEEEEMIWVRQAPGKGLEWVSAISRRGYSTYY  | 60 |
| BMS3h-38-238 | EVQLLASGGGLVQPGGSLRLSCAASGFTFEEEEMIWVRQAPGKGLEWVSAISRSGYSTYY  | 60 |
| BMS3h-38-228 | EVQLLASGGGLVQPGGSLRLSCAASGFTFEEEEMIWVRQAPGKGLEWVSAISRNGFSTYY  | 60 |
| BMS3h-38-235 | EVQLLASGGGLVQPGGSLRLSCAASGFTFEEEEMIWVRQAPGKGLEWVSAISRNGYSTYY  | 60 |
| BMS3h-38-231 | EVQLLASGGGLVQPGGSLRLSCAASGFPFEEEEMIWVRQAPGKGLEWVSAISRQGWSTYY  | 60 |
| BMS3h-38-237 | EVQLLASGGGLVQPGGSLRLSCAASGFTFEEEEMIWVRQAPGKGLEWVSAISRGGWSTYY  | 60 |
| BMS3h-38-218 | EVQLLASGGGLVQPGGSLRLSCAASGFTFEEEEMIWVRQAPGKGLEWVSAISRHGWSTYY  | 60 |
| BMS3h-38-215 | EVQLLASGGGLVQPGGSLRLSCAASGFTFEEEEMIWVRQAPGKGLEWVSAISGLGWSTYY  | 60 |
| BMS3h-38-223 | EVQLLASGGGLVQPGGSLRLSCAASGFTFEEEEMIWVRQAPGKGLEWVSAISGSGGSTYY  | 60 |
| BMS3h-38-224 | EVQLLASGGGLVQPGGSLRLSCAASGFTFEEEEMIWVRQAPGKGLEWVSAISGSGGSTYY  | 60 |
| BMS3h-38-225 | EVQLLASGGGLVQPGGSLRLSCAASGFTFEEEEMIWVRQAPGKGLEWVSAISGSGGGTYY  | 60 |
| BMS3h-38-219 | EVQLLASGGGLVQPGGSLRLSCAASGFTFEEEEMIWVRQAPGKGLEWVSSISRSGGSTYY  | 60 |
|              | ************************************ ******************* *  |    |

|              | CDR2                                             CDR3                                    |     |                       |
|--------------|------------------------------------------------------------------------------------------|-----|-----------------------|
| BMS3h-38-217 | ADSVKGRFTISRDNSKNTLYLQMNSLRAEDTAVYYCGKEPFRYDYWGQGTLVTVSS                                 | 116 | (SEQ ID NO: 264)      |
| BMS3h-38-238 | ADSVKGRFTISRDNSKNTLYLQMNSLRAEDTAVYYCGKEPFRYDYWGQGTLVTVSS                                 | 116 | (SEQ ID NO: 285)      |
| BMS3h-38-228 | ADSVKGRFTISRDNSKNTLYLQMNSLRAEDTAVYYCGKEPFRYDYWGQGTLVTVSS                                 | 116 | (SEQ ID NO: 275)      |
| BMS3h-38-235 | ADSVKGRFTISRDNSKNTLYLQMNSLRAEDTAVYYCGKEPFRYDYWGQGTLVTVSS                                 | 116 | (SEQ ID NO: 282)      |
| BMS3h-38-231 | ADSVKGRFTISRDNSKNTLYLQMNSLRAEDTAVYYCGKEPFRYDYWGQGTLVTVSS                                 | 116 | (SEQ ID NO: 278)      |
| BMS3h-38-237 | ADSVKGRFTISRDNSKNTLYLQMNSLRAEDTAVYYCGKEPFRYDYWGQGTLVTVSS                                 | 116 | (SEQ ID NO: 284)      |
| BMS3h-38-218 | ADSVKGRFTISRDNSKNTLYLQMNSLRAEDTAVYYCGKEPFRYDYWGQGTLVTVSS                                 | 116 | (SEQ ID NO: 265)      |
| BMS3h-38-215 | ADSVKGRFTISRDNSKNTLYLQMNSLRAEDTAVYYCGKEPFRYDYWGQGTLVTVSS                                 | 116 | (SEQ ID NO: 262)      |
| BMS3h-38-223 | ADSVKGRFTISRDNSKNTLYLQMNSLRAEDTAVYYCGKEPFMYDYWGQGTLVTVSS                                 | 116 | (SEQ ID NO: 270)      |
| BMS3h-38-224 | ADSVKGRFTISRDNSKNTLYLQMNSLRAEDTAVYYCGKEPFPYDYWGQGTLVTVSS                                 | 116 | (SEQ ID NO: 271)      |
| BMS3h-38-225 | ADSVKGRFTISRDNSKNTLYLQMNSLRAEDTAVYYCGKEPFRYDYWGQGTLVTVSS                                 | 116 | (SEQ ID NO: 272)      |
| BMS3h-38-219 | ADSVKGRFTISRDNSKNTLYLQMNSLRAEDTAVYYCGKEPFRYDYWGQGTLVTVSS                                 | 116 | (SEQ ID NO: 266)      |
|              | *******************************************************                                 |     |                       |

FIG. 7

```
                              CDR1                                        CDR2
BMS3h-198-22  EVQLLESGGGLVQPGGSLRLSCAASGFTFAGYEMWWVRQAPGKGLERVSAISGSGGSTYY 60
BMS3h-198-31  EVQLLESGGGLVQPGGSLRLSCAASGFTFAGYEMWWVRQAPGKGLERVSAISGSGGSTYY 60
BMS3h-198-33  EVQLLESGGGLVQPGGSLRLSCAASGFTFAGYEMWWVRQAPGKGLERVSAISGSGGSTYY 60
BMS3h-198-19  EVQLLESGGGLVQPGGSLRLSCAASGFTFAGYELMWVRQAPGKGLERVSAISGSGGSTYY 60
BMS3h-198-38  EVQLLESGGGLVQPGGSLRLSCAASGFTFAGYELMWVRQAPGKGLERVSAISGSGGSTYY 60
BMS3h-198-14  EVQLLESGGGLVQPGGSLRLSCAASGFTFAGYEMWWFRQAPGKGLERVSAISGSGGSTYY 60
              ************************************** ******************

CDR2                                      CDR3
BMS3h-198-22  ADSVKGRFTISRDDSKNTLYLQMNSLRAEDTAVYYCAKEPYSYDYWGHGTLVTVSS 116 (SEQ ID NO: 523)
BMS3h-198-31  ADSVKGRFTISRDNSKNTLYLQMNSLRAEDTAVYHCAKEPYSYDYWGQGTLVTVSS 116 (SEQ ID NO: 532)
BMS3h-198-33  ADSVKGRFTISRDDSKNTLYLQMNSLRAEDTAVYYCAKEPYSYDYWGQGTLVTVSS 116 (SEQ ID NO: 534)
BMS3h-198-19  ADSVKGRFTISRDDSKNTLYLQMNSLRAEDTAVYYCARDPYSFDYRGQGTLVTVSS 116 (SEQ ID NO: 520)
BMS3h-198-38  ADSVKGRFTISRDDSKNTLYLQMNSLRAEDTAVYYCARDPYSFDYWGQGTLVTVSS 116 (SEQ ID NO: 539)
BMS3h-198-14  ADSVKGRFTISRDDTKNTLYLQMNSLRAEDTAVYYCAKDPYSFDYWRQGTLVTVSS 116 (SEQ ID NO: 515)
              ************** ******************* *** ****  *  *******
```

ANTIBODY POLYPEPTIDES THAT ANTAGONIZE CD40

CROSS REFERENCE TO RELATED APPLICATIONS

This application is the National Stage of International Application No. PCT/US/2012/034519, filed Apr. 20, 2012, and claims the benefit of U.S. Provisional Application No. 61/477,904, filed Apr. 21, 2011, both of which are herein incorporated by reference in their entirety.

TECHNICAL FIELD

Antibodies and fragments thereof that target CD40, and do not exhibit CD40 agonist activity, compositions comprising the same, and methods of using the same for treatment of diseases involving CD40 activity are provided.

SEQUENCE LISTING

The instant application contains a substitute sequence listing which has been submitted in ASCII format via EFS-Web and is hereby incorporated by reference in its entirety. Said ASCII copy, created on Jan. 6, 2016 is named substitute_200896_0004_00_US_ST25.txt and is 1,188,730 bytes in size.

BACKGROUND

CD40 is a co-stimulatory molecule belonging to the tumor necrosis factor (TNF) receptor superfamily that is present on antigen presenting cells (APC), including dendritic cells, B cells, and macrophages. APCs are activated when CD40 binds its ligand, CD154 (CD40L), on $T_H$ cells. CD40-mediated APC activation is involved in a variety of immune responses, including cytokine production, up-regulation of co-stimulatory molecules (such as CD86), and enhanced antigen presentation and B cell proliferation. CD40 can also be expressed by endothelial cells, smooth muscle cells, fibroblasts, and epithelial cells.

CD40 activation is also involved in a variety of undesired T cell responses related to autoimmunity, transplant rejection, or allergic responses, for example. One strategy for controlling undesirable T cell responses is to target CD40 with an antagonistic antibody. For example, monoclonal antibody HCD122 (Lucatumumab), formerly known as Chiron 1212, is currently in clinical trials for the treatment of certain CD40-mediated inflammatory diseases. See "Study of HCD122 (Lucatumumab) and Bendamustine Combination Therapy in CD40+ Rituximab-Refractory Follicular Lymphoma," Clinical Trials Feeds, on the Internet at hypertext transfer protocol: clinicaltrialsfeeds.org/clinical-trials/show/NCT01275209 (last updated Jan. 11, 2011). Monoclonal antibodies, however, can display agonist activity. For example, the usefulness of the anti-CD40 antibody Chi220 is limited by its weak stimulatory potential. See Adams, et al., "Development of a chimeric anti-CD40 monoclonal antibody that synergizes with LEA29Y to prolong islet allograft survival," *J. Immunol.* 174: 542-50 (2005).

SUMMARY

Anti-CD40 antibody antagonists that do not possess partial agonist activity are still needed in a clinical setting. Novel antibody polypeptides that specifically bind a novel epitope of human CD40 are provided. The CD40 epitope does not overlap the Chi220 epitope, as shown by competition analysis and by the structure derived from co-crystallization of an antibody polypeptide with CD40. The antibody polypeptides advantageously do not exhibit CD40 agonist activity. The antibody polypeptides are useful in the treatment of diseases involving CD40 activation, including autoimmune diseases, transplant rejection, and allergic responses. The antibody polypeptides comprise a variable domain. In one embodiment, the antibody polypeptides are in the form of a domain antibody (dAb) that contains a single variable domain. In another embodiment, the dAbs are bi-specific reagents that comprise a second variable domain that can bind human serum albumin (HSA), for example.

Provided is an antibody polypeptide comprising a first variable domain, where said antibody polypeptide specifically binds an epitope of human CD40, where the epitope comprises the amino acid sequence of SEQ ID NO: 1, where the antibody polypeptide competes with the binding of domain antibody (dAb) BMS3h-56-269 (SEQ ID NO: 417), and where the epitope comprises at least one CD40 amino acid residue selected from the group consisting of Trp109, Leu121, His122, Ser124, Ser156, Ala157, Phe158, Glu159, and His162.

Further provided is an antibody polypeptide where the first variable domain comprises the amino acid sequence of one of the antibody polypeptides selected from the lineage group consisting of BMS3h-37, BMS3h-38, BMS3h-56, and BMS3h-198, and where the first variable domain has an apparent binding constant of 1 pM to 100 nM. Further provided is an antibody polypeptide where the first variable domain has an apparent binding constant of 1 pM to 10 nM.

Also provided is an antibody polypeptide where the amino acid sequence of the first variable domain comprises (a) a CDR1 region which differs from the CDR1 region of BMS3h-56-269 (SEQ ID NO: 417) by up to two amino acids, (b) a CDR2 region which differs from the CDR2 region of BMS3h-56-269 (SEQ ID NO: 417) by up to two amino acids, (c) a CDR3 region which differs from the CDR3 region of BMS3h-56-269 (SEQ ID NO: 417) by up to two amino acids, (d) a FR1 region which differs from the FR1 region of BMS3h-56-269 (SEQ ID NO: 417) by up to two amino acids, (e) a FR2 region which differs from the FR2 region of BMS3h-56-269 (SEQ ID NO: 417) by up to two amino acids, (f) a FR3 region which differs from the FR3 region of BMS3h-56-269 (SEQ ID NO: 417) by up to two amino acids, and (g) a FR4 region which differs from the FR4 region of BMS3h-56-269 (SEQ ID NO: 417) by up to two amino acids.

Also provided is an antibody polypeptide where the amino acid sequence of the first variable domain comprises (a) a CDR1 region which differs from the CDR1 region of BMS3h-56-269 (SEQ ID NO: 417) by up to two amino acids, (b) a CDR2 region which differs from the CDR2 region of BMS3h-56-269 (SEQ ID NO: 417) by up to two amino acids, (c) a CDR3 region which differs from the CDR3 region of BMS3h-56-269 (SEQ ID NO: 417) by up to two amino acids.

Further provided is an antibody polypeptide where the amino acid sequence of the first variable domain differs from the amino acid sequence of BMS3h-56-258 (SEQ ID NO: 10) or BMS3h-56-269 (SEQ ID NO: 417) by up to 10 amino acids.

Further provided is an antibody polypeptide where the amino acid sequence of the first variable domain differs from the amino acid sequence of BMS3h-56-258 (SEQ ID NO: 10) or BMS3h-56-269 (SEQ ID NO: 417) by up to 5 amino acids.

Further provided is an antibody polypeptide where the amino acid sequence of the first variable domain differs from the amino acid sequence of BMS3h-56-258 (SEQ ID NO: 10) or BMS3h-56-269 (SEQ ID NO: 417) by two amino acids.

Further provided is an antibody polypeptide where the amino acid sequence of the first variable domain differs from the amino acid sequence of BMS3h-56-258 (SEQ ID NO: 10) or BMS3h-56-269 (SEQ ID NO: 417) by one amino acid.

Further provided is an antibody polypeptide where the antibody polypeptide is selected from the lineage group of BMS3h-56, and where the amino acid sequence of the first variable domain further comprises: (a) a CDR1 region having a sequence $X_1$-Tyr-Glu-$Y_1$-Trp (SEQ ID NO: 1274), where $X_1$ is Asp or Gly, and $Y_1$ is Met or Leu; (b) a CDR2 region having a sequence Ala-Ile-Asn-Pro-$X_2$-Gly-$Y_2$-$Z_2$-Thr-Tyr-Tyr-Ala-Asp-Ser-Val-$A_2$-Gly (SEQ ID NO: 1275), where $X_2$ is Gln, Tyr, Pro, Trp, or Ala, $Y_2$ is Thr, Ser, Asn, Gly, Met, or Gln, $Z_2$ is Arg, Leu, Tyr, His, or Phe, and $A_2$ is Lys or Met; and (c) a CDR3 region having a sequence $X_3$-Pro-$Y_3$-$Z_3$-Phe-$A_3$-$B_3$ (SEQ ID NO: 1276), where $X_3$ is Leu or Pro, $Y_3$ is Phe, Gln, Thr, or Met, $Z_3$ is Tyr, Pro, Leu, Thr, Ile, Phe, or Met, $A_3$ is Gln, His, Asp, Ser, Lys, Glu, or Gly, and $B_3$ is Glu, Asp, or Tyr.

Further provided is an antibody polypeptide where the amino acid sequence of the first variable domain comprises: (a) a FR1 region having a sequence Glu-Val-Gln-Leu-Leu-Glu-Ser-Gly-Gly-Gly-Leu-Val-Gln-Pro-Gly-Gly-Ser-$X_1$-Arg-Leu-Ser-Cys-Ala-Ala-Ser-Gly-Phe-Thr-Phe-$Y_1$ (SEQ ID NO: 1277), where $X_1$ is Leu or Arg, and $Y_1$ is Arg or Ala; (b) a FR2 region having a sequence Trp-Val-Arg-$X_2$-Ala-Pro-Gly-$Y_2$-$Z_2$-Leu-Glu-Arg-Val-Ser (SEQ ID NO: 1278), where $X_2$ is Gln or Arg, $Y_2$ is Lys or Arg, and $Z_2$ is Gly or Val; (c) a FR3 region having a sequence Arg-Phe-Thr-Ile-Ser-Arg-Asp-Asn-Ser-Lys-Asn-$X_3$-Leu-Tyr-Leu-Gln-Met-Asn-Ser-Leu-Arg-Ala-$Y_3$-Asp-Thr-$Z_3$-Val-Tyr-$A_3$-Cys-$B_3$-Lys (SEQ ID NO: 1279), where $X_3$ is Thr or Met, $Y_3$ is Glu or Asp, $Z_3$ is Ala or Ser, $A_3$ is Tyr or His, and $B_3$ is Ala or Thr; and (d) a FR4 region having a sequence $X_4$-Gly-$Y_4$-Gly-Thr-Leu-Val-Thr-Val-Ser-$Z_4$ (SEQ ID NO: 1280), where $X_4$ is Trp or Arg, $Y_4$ is Gln or Pro, and $Z_4$ is Ser or Asn.

Further provided is an antibody polypeptide where the first variable domain comprises the amino acid sequence of BMS3h-56-258 (SEQ ID NO: 10) or BMS3h-56-269 (SEQ ID NO:417).

Further provided is an antibody polypeptide where the antibody polypeptide is selected from the lineage group of BMS3h-37, where the first variable domain comprises the sequence Glu-Val-Gln-Leu-Leu-Glu-Ser-Gly-Gly-Gly-Leu-Val-$X_1$-Pro-Gly-Gly-Ser-Leu-Arg-Leu-Ser-Cys-Ala-Ala-Ser-Gly-Phe-Thr-Phe-Glu-Trp-Tyr-Glu-Met-Gln-Trp-Val-Arg-Arg-Ala-Pro-Gly-Lys-Gly-Leu-Glu-Trp-Val-Ser-Ala-Ile-Ser-Gly- Asp-Gly-Tyr-Arg-Thr-Tyr-Tyr-Ala-Asp-Ser-Val-Lys-Gly-Arg-Phe-Thr-Ile-Ser-Arg-Asp-Asn-Ser-Lys-Asn-Thr-Leu-Tyr-Leu-Gln-Met-Asn-Ser-Leu-Arg-Ala-Glu-Asp-Thr-Ala-Val-Tyr-Tyr-Cys-Ala-Lys-$Y_1$-Leu-$Z_1$-$A_1$-Phe-Asp-Tyr-$B_1$-Gly-Arg-Gly-Thr-Leu-Val-Thr-Val-Ser-Ser (SEQ ID NO: 1281); and where $X_1$ is Gln or Arg; $Y_1$ is Glu or Gly; $Z_1$ is Ala, Leu, or Glu; $A_1$ is Phe or Tyr; and $B_1$ is Trp or Arg.

Also provided is an antibody polypeptide where the antibody polypeptide is selected from the lineage group of BMS3h-38, where the first variable domain comprises the sequence Glu-Val-Gln-Leu-Leu-Ala-Ser-Gly-Gly-Gly-Leu-Val-Gln-Pro-Gly-Gly-Ser-Leu-Arg-Leu-Ser-Cys-Ala-Ala-Ser-Gly-Phe-$X_1$-Phe-Glu-Glu-Glu-Glu-Met-Ile-Trp-Val-Arg-Gln-Ala-Pro-Gly-Lys-Gly-Leu-Glu-Trp-Val-Ser-$Y_1$-Ile-Ser-$Z_1$-$A_1$-Gly-$B_1$-$C_1$-Thr-Tyr-Tyr-Ala-Asp-Ser-Val-Lys-Gly-Arg-Phe-Thr-Ile-Ser-Arg-Asp-Asn-Ser-Lys-Asn-Thr-Leu-Tyr-Leu-Gln-Met-Asn-Ser-Leu-Arg-Ala-Glu-Asp-Thr-Ala-Val-Tyr-Tyr-Cys-Gly-Lys- Glu-Pro-Phe-$D_1$-Tyr-Asp-Tyr-Trp-Gly-Gln-Gly-Thr-Leu-Val-Thr-Val-Ser-Ser (SEQ ID NO: 1282); and where $X_1$ is Thr or Pro; $Y_1$ is Ala or Ser; $Z_1$ is Arg or Gly; $A_1$ is Arg, Ser, Asn, Gln, Gly, His, or Leu; $B_1$ is Tyr, Phe, Trp, or Gly; $C_1$ is Ser or Gly; and $D_1$ is Arg, Met, or Pro.

Also provided is an antibody polypeptide where the antibody polypeptide is selected from the lineage group of BMS3h-198, where the first variable domain comprises the sequence Glu-Val-Gln-Leu-Leu-Glu-Ser-Gly-Gly-Gly-Leu-Val-Gln-Pro-Gly-Gly-Ser-Leu-Arg-Leu-Ser-Cys-Ala-Ala-Ser-Gly-Phe-Thr-Phe-Ala-Gly-Try-Glu-$X_1$-Trp-Trp-$Y_1$-Arg-Gln-Ala-Pro-Gly-Lys-Gly-Leu-Glu-Arg-Val-Ser-Ala-Ile-Ser-Gly-Ser-Gly-Gly-Ser-Thr-Tyr-Tyr-Ala-Asp-Ser-Val-Lys-Gly-Arg-Phe-Thr-Ile-Ser-Arg-Asp-$Z_1$-$A_1$-Lys-Asn-Thr-Leu-Tyr-Leu-Gln-Met-Asn-Ser-Leu-Arg-Ala-Glu-Asp-Thr-Ala-Val-Tyr-$B_1$-Cys-Ala-$C_1$-$D_1$-Pro-Tyr-Ser-$E_1$-Asp-Tyr-$F_1$-$G_1$-$H_1$-Gly-Tbr-Leu-Val-Thr-Val-Ser-Ser (SEQ ID NO: 1283); and where $X_1$ is Met or Leu; $Y_1$ is Val or Phe; $Z_1$ is Asp or Asn; $A_1$ is Ser or Thr; $B_1$ is Tyr or His; $C_1$ is Lys or Arg; $D_1$ is Asp or Glu; $E_1$ is Tyr or Phe; $F_1$ is Trp or Arg; $G_1$ is Gly or Arg; and $H_1$ is Gln or His.

Further provided is an antibody polypeptide where the antibody polypeptide is a domain antibody (dAb).

Further provided is an antibody polypeptide where the variable domain is fused to an Fc domain.

Further provided is an antibody polypeptide where the antibody polypeptide further comprises a second variable domain that specifically binds a second antigen, where the second antigen is an antigen other than human CD40.

Also provided is an antibody polypeptide where the second antigen is a cluster of differentiation (CD) molecule or a Major Histocompatibility Complex (MHC) Class II molecule.

Also provided is an antibody polypeptide where the second antigen is serum albumin (SA).

Provided is a nucleic acid encoding the antibody polypeptide disclosed herein.

Also provided is a vector comprising the nucleic acid disclosed herein.

Also provided is a host cell comprising the vector disclosed herein.

Provided is a pharmaceutical composition comprising a therapeutically-effective amount of the antibody polypeptide disclosed herein and a pharmaceutically acceptable carrier. Also provided is a pharmaceutical composition further comprising an immunosuppressive/immunomodulatory and/or anti-inflammatory agent.

Provided is a method of treating an immune disease in a patient in need of such treatment, comprising administering to the patient a therapeutically effective amount of the pharmaceutical composition disclosed herein. Also provided is a method where the pharmaceutical composition is administered in combination with an immunosuppressive/immunomodulatory and/or anti-inflammatory agent.

Provided is a method of treating an immune disease where the immune disease is an autoimmune disease or a graft-related disease. Further provided is a method of treating an immune disease where the immune disease is selected from the group consisting of selected from the group consisting of Addison's disease, allergies, ankylosing spondylitis, asthma, atherosclerosis, autoimmune diseases of the ear, autoimmune diseases of the eye, autoimmune hepatitis, autoimmune parotitis, colitis, coronary heart disease, Crohn's disease, diabetes, including Type 1 and/or Type 2 diabetes, epididymitis, glomerulonephritis, Graves' disease, Guillain-Barre syndrome, Hashimoto's disease, hemolytic anemia, idiopathic thrombocytopenic purpura, inflammatory bowel disease, immune response to recombinant drug products, systemic lupus erythematosus, male infertility, multiple sclerosis, myasthenia gravis, pemphigus, psoriasis, rheumatic fever, rheumatoid arthritis, sarcoidosis, scleroderma, Sjogren's syndrome, spondyloarthropathies, thyroiditis, transplant rejection, vasculitis, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus's phenomenon, anaphylaxis, alcohol addiction, and drug addiction.

Also provided is a method of targeting CD40 using a first variable domain that specifically binds an epitope of human CD40 comprising the amino acid sequence of SEQ ID NO: 1, where the antibody polypeptide competes with the binding of domain antibody (dAb) BMS3h-56-269 (SEQ ID NO:417).

Provided is the use in medicine of an antibody polypeptide comprising a first variable domain that specifically binds an epitope of human CD40 comprising the amino acid sequence of SEQ ID NO: 1, wherein the antibody polypeptide competes with the binding of domain antibody (dAb) BMS3h-56-201 (SEQ ID NO: 9), or a pharmaceutically acceptable salt thereof.

Provided is the use of an antibody polypeptide comprising a first variable domain that specifically binds an epitope of human CD40 comprising the amino acid sequence of SEQ ID NO: 1, wherein the antibody polypeptide competes with the binding of domain antibody (dAb) BMS3h-56-201 (SEQ ID NO: 9), or a pharmaceutically acceptable salt thereof, in the preparation of a medicament for treatment of an immune disease. In some embodiments, the pharmaceutical composition is administered in combination with an immunosuppressive/immunomodulatory and/or anti-inflammatory agent. In further embodiments, the immune disease is an autoimmune disease or a graft-related disease. In yet further embodiments, the immune disease is selected from the group consisting of selected from the group consisting of Addison's disease, allergies, ankylosing spondylitis, asthma, atherosclerosis, autoimmune diseases of the ear, autoimmune diseases of the eye, autoimmune hepatitis, autoimmune parotitis, colitis, coronary heart disease, Crohn's disease, diabetes, including Type 1 and/or Type 2 diabetes, epididymitis, glomerulonephritis, Graves' disease, Guillain-Barre syndrome, Hashimoto's disease, hemolytic anemia, idiopathic thrombocytopenic purpura, inflammatory bowel disease, immune response to recombinant drug products, systemic lupus erythematosus, male infertility, multiple sclerosis, myasthenia gravis, pemphigus, psoriasis, rheumatic fever, rheumatoid arthritis, sarcoidosis, scleroderma, Sjogren's syndrome, spondyloarthropathies, thyroiditis, transplant rejection, vasculitis, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus's phenomenon, anaphylaxis, alcohol addiction, and drug addiction.

Provided is an antibody polypeptide comprising a first variable domain that specifically binds an epitope of human CD40 comprising the amino acid sequence of SEQ ID NO: 1, wherein the antibody polypeptide competes with the binding of domain antibody (dAb) BMS3h-56-201 (SEQ ID NO: 9), or a pharmaceutically acceptable salt thereof, for use in the preparation of a medicament for treatment of an immune disease. The medicament can, for example, be administered in combination with an immunosuppressive/immunomodulatory and/or anti-inflammatory agent. The immune disease can be, for example, an autoimmune disease or a graft-related disease. The immune disease can also be selected from the group consisting of selected from the group consisting of Addison's disease, allergies, ankylosing spondylitis, asthma, atherosclerosis, autoimmune diseases of the ear, autoimmune diseases of the eye, autoimmune hepatitis, autoimmune parotitis, colitis, coronary heart disease, Crohn's disease, diabetes, including Type 1 and/or Type 2 diabetes, epididymitis, glomerulonephritis, Graves' disease, Guillain-Barre syndrome, Hashimoto's disease, hemolytic anemia, idiopathic thrombocytopenic purpura, inflammatory bowel disease, immune response to recombinant drug products, systemic lupus erythematosus, male infertility, multiple sclerosis, myasthenia gravis, pemphigus, psoriasis, rheumatic fever, rheumatoid arthritis, sarcoidosis, scleroderma, Sjogren's syndrome, spondyloarthropathies, thyroiditis, transplant rejection, vasculitis, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus's phenomenon, anaphylaxis, alcohol addiction, and drug addiction.

BRIEF DESCRIPTION OF THE FIGURES

The patent or application file contains at least one drawing executed in color. Copies of this patent or patent application publication with color drawing(s) will be provided by the Office upon request and payment of the necessary fee.

FIG. 3 depicts binding of a PEGylated anti-human CD40 dAb, BMS3h38-2C-P40Br, on blood samples from human and primate species.

Figure 4:
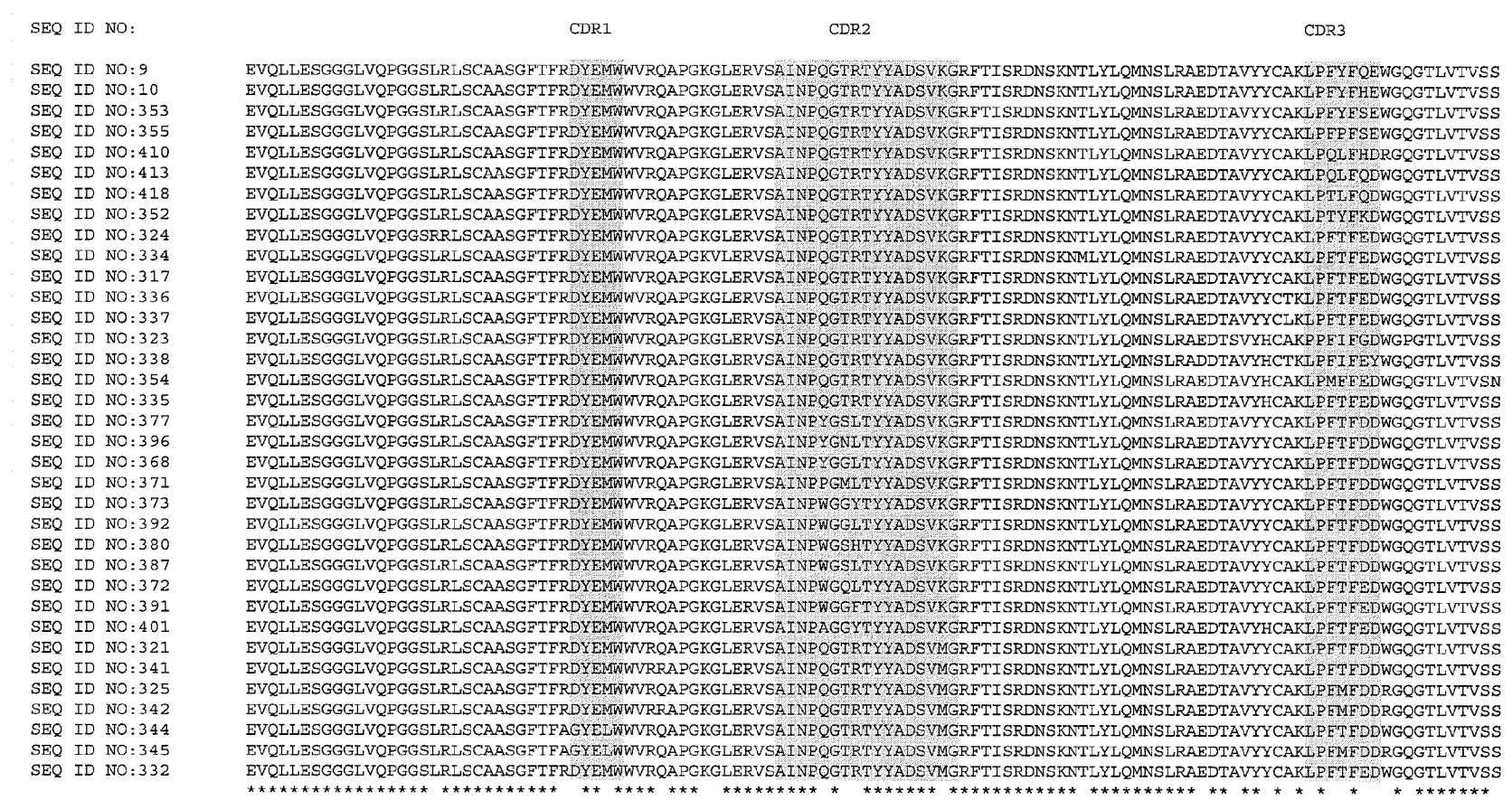

FIG. 4, FIG. 5, FIG. 6, and FIG. 7 show ClustalW2 alignments of representative domain antibody polypeptides from lineages BMS3h-56, BMS3h-37, BMS3h-38, and BMS3h-198, respectively.

DETAILED DESCRIPTION

Figure 1:
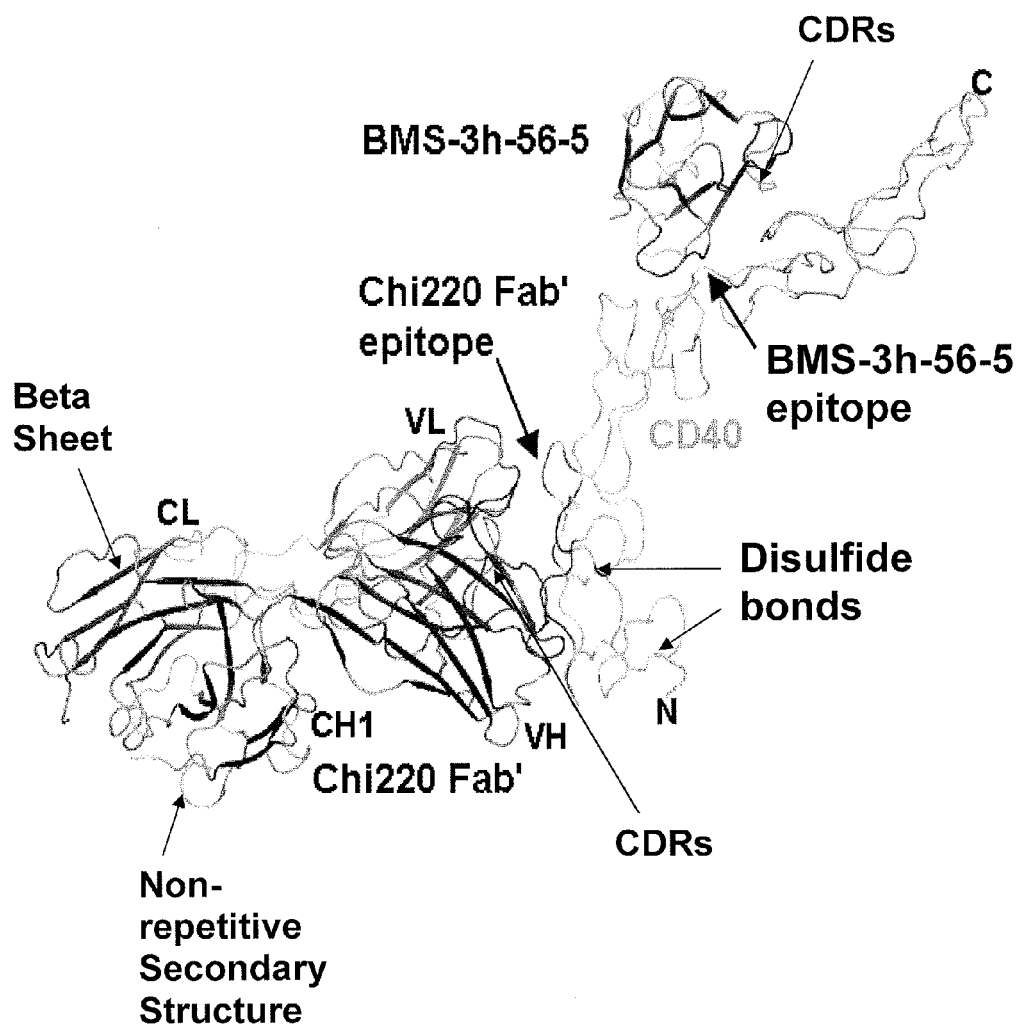
FIG. 1 depicts the binding modes of two different co-crystal structures of human CD40 (SEQ ID NO: 1), one with the dAb BMS3h-56-5 (SEQ ID NO: 321) and one with the Fab' of Chi220 antibody. The BMS3h-56-5 and Chi 220 Fab' molecules are shown as cartoons with β-strands (represented as arrows in the dAb) and non-repetitive secondary structure (represented as loops in th dAb). Complementarity-determining regions (CDRs) are also shown CD40 is also shown as a cartoon with the BMS3h-56-5 epitope residues of human CD40. The Chi220 epitope residues are also shown. Disulfide bonds are also shown The N-terminus (N) and C-terminus (C) of CD40 are labeled.

Antibody polypeptides that specifically bind to human CD40 are provided. The antibody polypeptides do not exhibit CD40 agonist activity, and the antibody polypeptides are useful in the treatment of diseases involving CD40 activation, such as autoimmune diseases. The antibody polypeptides may be selected using a primary screen that utilizes cell binding assays, followed by one or more rounds of error-prone or degenerate oligonucleotide-directed affinity maturation. As a result, a genus of antibody polypeptides that specifically bind a single CD40 epitope are provided.

A "lineage" is a set of related antibody polypeptides that were prepared from a common precursor by error-prone or degenerate oligonucleotide-directed affinity maturation, as disclosed in the examples below, and that are expected to bind the same CD40 epitope. The nomenclature of the antibody polypeptides is used to designate the various lineages. The nomenclature "BMS3h-56," for example, refers to antibody poly/peptides of lineage 56, which were raised against human CD40. "Lineage BMS3h-56" antibody polypeptides include BMS3h-56-1 through BMS3h-56-33, and BMS3h-56-202 through BMS3h-56-288.

Accordingly, in one aspect, an antibody polypeptide comprises a variable domain that specifically binds human CD40, where the antibody polypeptide competes with the binding of any one of the domain antibodies (dAbs) listed in TABLE 3. For example, the dAb may belong to a lineage selected from the group consisting of BMS3h-37, BMS3h-38, BMS3h-41, BMS3h-43, BMS3h-56, BMS3h-131, BMS3h-198, and BMS3h-202, such as the dAb BMS3h-56-5, BMS3h-56-201, or BMS3h-56-258, for instance. In another aspect, an antibody polypeptide specifically binds the same human CD40 epitope as any one of the dAbs listed in TABLE 3. For example, the antibody polypeptide may comprise a variable domain that specifically binds the same human CD40 epitope as the dAb BMS3h-56-5, BMS3h-56-201, or BMS3h-56-258, for instance. As disclosed below, the human CD40 epitope may comprise amino acid residue Trp109 of SEQ ID NO: 1, for example.

The antibody polypeptides may be domain antibodies containing a single variable domain. The antibody polypeptides also may comprise additional domains, such as an Fc domain. For instance, the antibody polypeptide may comprise a second variable domain that specifically binds human serum albumin (HSA). Such dual specific antibody polypeptides may have an increased half-life, for example.

In the Sequence Listing, SEQ ID NO: 1 is the amino acid sequence of human CD40; SEQ ID NO: 2 is the amino acid sequence of *Macaca fascicularis* CD40. The amino acid sequence of the domain antibody BMS3h-56-5 is SEQ ID NO: 321.

As used herein, "specific binding" refers to the binding of an antigen by an antibody polypeptide with a dissociation constant ($K_d$) of about 1 μM or lower as measured, for example, by surface plasmon resonance. Suitable assay systems include the BIAcore™ surface plasmon resonance system and BIAcore™ kinetic evaluation software (e.g., version 2.1). The affinity or $K_d$ for a specific binding interaction may be about 500 nM or lower or about 300 nM or lower.

The term "about" will be understood by persons of ordinary skill in the art and will vary to some extent on the context in which it is used. Generally, about encompasses a range of values that are plus/minus 10% of a referenced value.

In accordance with this detailed description, the following abbreviations and definitions apply. It must be noted that as used herein, the singular forms "a", "an", and "the" include plural referents unless the context clearly dictates otherwise. Thus, for example, reference to "an antibody" includes a plurality of such antibodies and reference to "the dosage" includes reference to one or more dosages and equivalents thereof known to those skilled in the art, and so forth.

1. CD40 and CD40 Activities

Antibody polypeptides are provided that bind human CD40. CD40 is also known as B-cell surface antigen CD40, Bp50, CD40L receptor, CDw40, CDW40, MGC9013, p50, TNFRSF5, and Tumor necrosis factor receptor superfamily member 5. Relevant structural information for human CD40 can be found, for example, at UniProt Accession Numbers P25942, Q9BYU0, and Q53GN5. "Human CD40" refers to the CD40 comprising the following amino acid sequence:

```
                                              (SEQ ID NO: 1)
MVRLPLQCVL WGCLLTAVHP EPPTACREKQ YLINSQCCSL

CQPGQKLVSD CTEFTETECL PCGESEFLDT WNRETHCHQH

KYCDPNLGLR VQQKGTSETD TICTCEEGWH CTSEACESCV

LHRSCSPGFG VKQIATGVSD TICEPCPVGF FSNVSSAFEK

CHPWTSCETK DLVVQQAGTN KTDVVCGPQD RLRALVVIPI

IFGILFAILL VLVFIKKVAK KPTNKAPHPK QEPQEINFPD

DLPGSNTAAP VQETLHGCQP VTQEDGKESR ISVQERQ.
```

CD40 also has been sequenced in *Mus musculus, Sus scrofa, Bos taurus, Gallus gallas, Canis familiaris, Macaca fascicularis* (cynomolgus monkey), *Ovis aries, Equus caballus*, and *Rattus norvegicus*.

Binding of the present antibody polypeptides to CD40 antagonizes CD40 activity. "CD40 activities" include, but are not limited to, T cell activation (e.g., induction of T cell proliferation or cytokine secretion), macrophage activation (e.g., the induction of reactive oxygen species and nitric oxide in the macrophage), and B cell activation (e.g., B cell proliferation, antibody isotype switching, or differentiation to plasma cells). CD40 activities can be mediated by interaction with other molecules. "CD40 activities" include the functional interaction between CD40 and the following molecules, which are identified by their Uniprot Accession Number is parentheses:

| | |
|---|---|
| CALR | (P27797); |
| ERP44 | (Q9BS26); |
| FBL | (P22087); |
| POLR2H | (P52434); |
| RFC5 | (P40937); |
| SGK1 | (O00141); |
| SLC30A7 | (Q8NEW0); |
| SLC39A7 | (Q92504); |
| TRAF2 | (Q5T1L5); |
| TRAF3 | (Q13114); |
| TRAF6 | (Q9Y4K3); |
| TXN | (Q5T937); |
| UGGT1 | (Q9NYU2); and |
| USP15 | (Q9Y4E8). |

For example, a CD40 "activity" includes an interaction with TRAF2. CD40/TRAF2 interaction activates NF-κB and JNK. See Davies et al., *Mol. Cell. Biol.* 25: 9806-19 (2005). This CD40 activity thus can be determined by CD40-dependent cellular NF-κB and JNK activation, relative to a reference.

As used herein, the terms "activate," "activates," and "activated" refer to an increase in a given measurable CD40 activity by at least 10% relative to a reference, for example, at least 10%, 25%, 50%, 75%, or even 100%, or more. A CD40 activity is "antagonized" if the activity is reduced by at least 10%, and in an exemplary embodiment, at least about 20%, 30%, 40%, 50%, 60%, 70%, 80%, 90%, 95%, 97%, or even 100% (i.e., no detectable activity), relative to the absence of the antagonist. For example, an antibody polypeptide may antagonize some or all CD40 activity, while not activating CD40. In one embodiment, the antibody polypeptide does not activate B cell proliferation. In another embodiment, the antibody polypeptide does not activate cytokine secretion by T cells, where the cytokine is at least one cytokine selected from the group consisting of IL-2, IL-6, IL-10, IL-13, TNF-α, IFN-γ.

2. The CD40 Epitope

X-ray crystallography of a complex between human CD40 (SEQ ID NO: 1) and the dAb BMS3h-56-5 (SEQ ID NO: 321) was used to reveal an epitope recognized by the antibody polypeptides of the disclosure. Structural models of CD40 and BMS3h-56-5 were fitted to electron density data to yield seven models or versions of the CD40/BMS3h-56-5 complex, which come from three crystallographically independent complexes in one crystal form and four crystallographically independent complexes in a second crystal form. The versions have real space correlation coefficients of about 0.92 for main-chain atoms and 0.80 for side-chain atoms. The CD40 molecule has a certain amount of flexibility in the seven versions, but the overall nature of the CD40/BMS3h-56-5 interaction is retained in all versions. The versions differ in the interaction between the CD40 residue Trp109 and BMS3h-56-5 Trp103 (Kabat Numbering, see below). BMS3h-56-5 Trp103 forms an edge-to-face interaction with CD40 Trp109 in one version, while forming a displaced stacking (i.e., face-to-face) interaction in other versions.

The shape complementarity statistic, Sc, for the seven versions ranges from 0.70-0.77, which shows a higher degree of shape complementarity than for typical antibody/antigen complexes. For example, these values compare to ranges of 0.71-0.76 for four protease/protein inhibitor complexes, 0.70-0.74 for five oligomeric interfaces, and 0.64-0.68 for six antibody/antigen complexes. See Lawrence et al., "Shape Complementarity at Protein/Protein Interfaces," *J. Mol. Biol.* 234: 946-950 (1993).

A model of the human CD40/BMS3H-56-5 complex is shown in FIG. 1. One BMS3h-56-5 dAb binds to one CD40 molecule. The BMS3h-56-5 epitope does not overlap the Chi220 Fab' fragment epitope. All versions of the complex define a set of CD40 residues that contact BMS3h-56-5: Trp109, Leu121, His122, Ser124, Ser156, Ala157, Phe158, Glu159, and His162 (with reference to SEQ ID NO: 1). CD40 residues that contact BMS3h-56-5 in some versions of the complex are Pro85, Asn86, Leu87, Gly88, Glu106, Glu107, Gly108, His110, Thr112, Cys119, Val120, Gln133, Ile134, Ala135, Thr136, Ser155, and Lys160. Val154 is a buried CD40 residue in all versions. Other CD40 residues buried in some versions are Ser118, Arg123, Thr141, Phe151, Asp153, Cys161, and Pro163.

As used herein, the term "in contact" refers to an interatomic distance whose maximum is determined by an atom type distance dependency as defined by Sheriff et al., *J. Mol. Biol.* 197: 273-296 (1987) and Sheriff, *Immunomethods* 3: 191-196 (1993).

As used herein, the term "buried" refers to a residue that has a least one atom with surface area defined by the program MS (Connolly, *J. Appl. Crystallogr.* 16: 548-558 (1983)), a probe sphere of 1.7 Å, and atom type dependent Van der Waals radii as defined by Sheriff, *Immunomethods* 3: 191-196 (1993).

Figure 2:
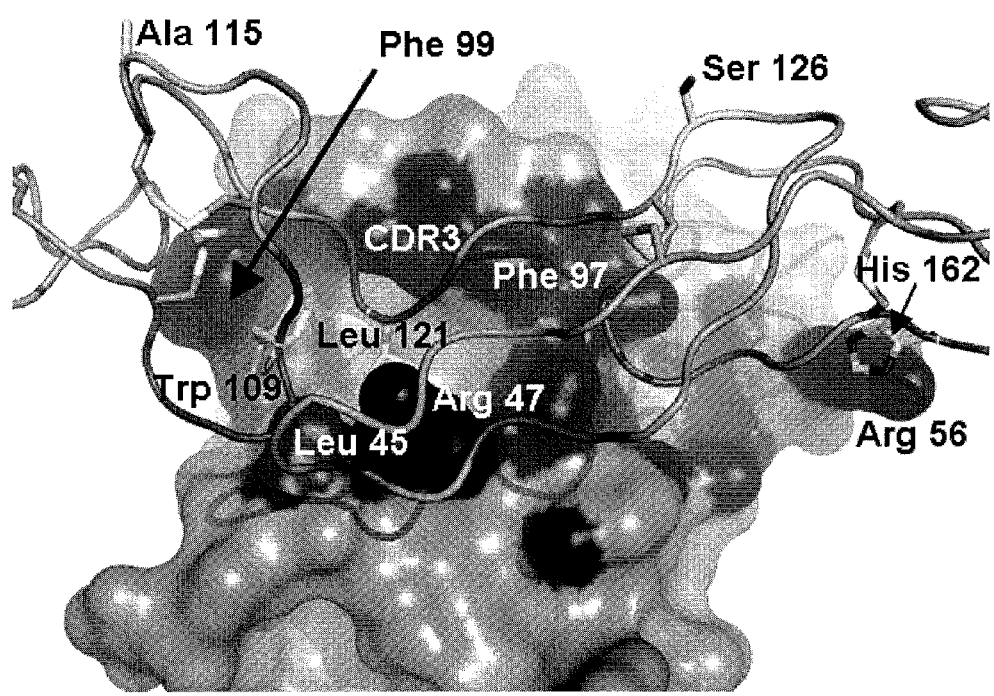
FIG. 2 depicts a space filling model of BMS3h-56-5 (SEQ ID NO: 321) contacting human CD40 (SEQ ID NO: 1), which is shown as a cartoon. Surface residues of the dAb BMS3h-56-5 that contact CD40 are shown. The BMS3h-56-5 CDR3 region and FR-2 residues Leu45, Arg47, Arg56 and Phe99 are labeled. Kabat numbering (Kabat et al., *Sequences of Immunological Interest*, 5$^{th}$ ed., U.S. Dept. Health & Human Services, Washington, D.C. (1991)) is used in this diagram and differs from sequential numbering in that insertion residues are used to keep the residue numbering of the β-strands identical. Thus for BMS3h-56-5, sequential residue 53 becomes residue 52A, sequential residues 84, 85, and 86 become, respectively, 82A, 82B, 82C and Kabat residue number 100 is missing (it would be between sequential residues 103 and 104); CD40 is also represented as a cartoon with non-repetitive secondary structure and the BMS3h-56-5 epitope. CD40 residues that differ between human and *Macaca fascicularis* (cynomolgus monkey), Ala115, Phe99, Ser126, His162, Leu121, and Trp109, are shown in stick representation. CD40 residues that differ between human and cynomolgus monkey that are part of the BMS3h-56-5 epitope are Trp109, Leu121, and His162. CD40 residues Trp109 and Leu121 lie in a cleft between the BMS3h-56-5 CDR3 and FR-2. Mutation of Trp109 either greatly reduces or ablates BMS3h-56-5 activity.

FIG. 2 shows the surface of BMS3h-56-5 (SEQ ID NO: 321) including contacting residues and buried residues. CD40 (SEQ ID NO: 1) is represented as a ribbon diagram with orange representing non-repetitive secondary structure and magenta representing the epitope residues. CD40 residues Trp109, Ala115, Leu121, Ser126, and His162, which are shown, differ in various non-human primate sequences. CD40 residues Ala115 and Ser126 are on the opposite side of the BMS3h-56-5 binding site. Trp109 and Leu121 bind in a cleft that lies between CDR3 and FR-2 (residues Leu45 and Arg47) of BMS3h-56-5. His162 interacts with residues in CDR2 of BMS3h-56-5, especially Lys 56. In summary, the CD40 epitope comprises one or more residues listed in TABLE 1, with reference to the numbering used in SEQ ID NO: 1.

TABLE 1

| CD40 residues contacting BMS3h-56-5: |
|---|
| Trp109, Leu121, His122, Ser124, Ser156, Ala157, Phe158, Glu159, His162 |

BMS3h-56-5, like the other dAbs listed in TABLE 3, was prepared by a screening and affinity maturation method described in more detail below, using human CD40 as the antigen. It is expected that dAbs created by affinity maturation from a common precursor dAb will bind the same human CD40 epitope. Competition studies described below, for example, indicate that dAbs generated from a common precursor dAb by affinity maturation compete for binding with each other to human CD40. The same competition studies, however, show that the dAbs do not compete with at least the Chi220 or G28-5 antibodies.

3. Antibody Polypeptides

The antibody polypeptides comprise a variable domain. In one embodiment, the antibody polypeptides are in the form of a dAb that contains a single variable domain. Antibody polypeptides may be full-length anti-CD40 immunoglobulin molecules comprising two heavy (H) chains and two light (L) chains interconnected by disulfide bonds. In this embodiment, the amino terminal portion of each chain includes a variable domain ($V_L$ or $V_H$) of about 100-110 amino acids primarily responsible for antigen recognition via the complementarity determining regions (CDRs) contained therein. The carboxy-terminal "half" of each heavy chain defines a constant region (Fe) primarily responsible for effector function.

Antibody polypeptides also may be "fragments" comprising a portion of the full-length anti-CD40 immunoglobulin molecule that comprises a variable domain that specifically binds CD40. Thus, the term "antibody polypeptides" includes an antigen-binding heavy chain, light chain, heavy chain-light chain dimer, Fab fragment, F(ab')$_2$ fragment, Fv fragment, single chain Fv (scFv), and dAb, for example. The term "antibody polypeptides" thus includes polypeptides made by recombinant engineering and expression, as well as monoclonal antibodies produced by natural recombination and secretion by hybridoma cell clones.

Light chains are classified as kappa (κ) or lambda (λ), and are characterized by a particular constant region, $C_L$, as known in the art. Heavy chains are classified as γ, μ, α, δ, or ε, and define the isotype of an antibody as IgG, IgM, IgA, IgD, or IgE, respectively. The heavy chain constant region is comprised of three domains (CH1, CH2, and CH3) for IgG, IgD, and IgA; and four domains (CH1, CH2, CH3, and CH4) for IgM and IgE. Anti-CD40 antibodies may have a heavy chain constant region selected from any of the immunoglobulin classes (IgA, IgD, IgG, IgM, and IgE).

Each light chain variable domain ($V_L$) and heavy chain variable domain ($V_H$) is composed of three CDRs and four framework regions (FRs), arranged from amino-terminus to carboxy-terminus in the following order: FR1, CDR1, FR2, CDR2, FR3, CDR3, FR4. The three CDRs of the light chain are referred to as "LCDR1, LCDR2, and LCDR3" and the three CDRs of the heavy chain are referred to as "HCDR1, HCDR2, and HCDR3."

As used herein, the term "Fc domain" refers to the constant region antibody sequences comprising CH2 and CH3 constant domains as delimited according to Kabat et al., *Sequences of Immunological Interest*, 5$^{th}$ ed., U.S. Dept. Health & Human Services, Washington, D.C. (1991). The Fc region may be derived from an IgG1 or an IgG4 Fc region, for example. A variable domain may be fused to an Fc domain. In this case, the carboxyl terminus of the variable domain (either a $V_L$ or $V_H$ domain, including dAbs) may be linked or fused to the amino terminus of the Fc CH2 domain. Alternatively, the carboxyl terminus of the variable domain may be linked or fused to the amino terminus of a CH1 domain, which itself is fused to the Fc CH2 domain. The protein may comprise the hinge region between the CH1 and CH2 domains in whole or in part.

The CDRs contain most of the residues that form specific interactions with the antigen. As shown in FIG. 2, for example, CDR2 and CDR3, plus FR4 residue Trp103, form most of the contacts between CD40 and the dAb BMS3h-56-5. For example, the variable domain of an antibody polypeptide comprises CDR1, CDR2, and CDR3 regions that have the same amino acid sequence as the CDR1, CDR2, and CDR3 regions of one of the dAbs listed in TABLE 3 or that each differ from the CDR1, CDR2, and CDR3 regions by one or two amino acids. For example, the antibody polypeptide may comprise CDR1, CDR2, and CDR3 regions that have the same amino acid sequence as the CDR1, CDR2, and CDR3 regions of BMS3h-56-5, BMS3h-56-258, or BMS3h-56-201, for example.

A "domain antibody" (dAb) comprises a single variable ($V_L$ or $V_H$) domain that is capable of specifically and monovalently binding an antigen, such as CD40. For example, a dAb may have a $V_{HH}$ structure, characteristic of a camelid dAb. A "$V_H$ domain" as used herein is meant to include a $V_{HH}$ structure. In another embodiment, the $V_H$ domains of the present invention (including all features and combination of features presented as embodiments herein) are other than $V_{HH}$ domains. dAbs may form homo- or heterodimers in solution. Bivalent anti-CD40 antibodies are believed to exhibit agonist activity because of the ability to cross-link bound CD40 molecules on the cell surface. While not limited by any particular theory, it is believed that monovalent dAbs do not activate CD40, because the dAbs do not cross-link CD40.

As used herein, the term "variable domain" refers to immunoglobulin variable domains defined by Kabat et al., *Sequences of Immunological Interest*, 5$^{th}$ ed., U.S. Dept. Health & Human Services, Washington, D.C. (1991). The numbering and positioning of CDR amino acid residues within the variable domains is in accordance with the well-known Kabat numbering convention. For example, the Kabat numbering for BMS3h-56-5 (SEQ ID NO: 321) is compared in TABLE 2 to the same sequence numbered sequentially. In the Kabat numbering, BMS3h-56-5 has insertion residues 52A, 82A, 82B, 82C, and is missing residue 100. In both numbering systems, the Ser and Thr at the N-terminus that are part of the expression construct are given negative numbers.

TABLE 2

```
              -2-1
              ||
BMS3h-56-5    ST

CDR1
Kabat                10        20        30         40         50
                -    |    -    |    -    |     -    |     -    |
Sequential           10        20        30         40         50
                -    |    -    |    -    |     -    |     -    |
BMS3h-56-5    EVQLLESGGGLVQPGGSLRLSCAASGFTFRDYEMWWVRQAPGKGLERVSA CDR2
Kabat                60        70         80               90
                A -   |    -   |    -     |  ABC   -   |        -
Sequential           60        70         80               90       100
                -    |    -    |    -     |    -       |    -   |
BMS3h-56-5    INPQGTRTYYADSVMGRFTISRDNSKNTLYLQMNSLRAEDTAVYYCAKLP
```

TABLE 2-continued

```
                  CDR3
Kabat             101      110    116
                  |    -   |     -|
Sequential             110      119
                     -  |     -  |
BMS3h-56-5     FTFDDWGQGTLVTVSSAAA (SEQ ID NO: 3)
```

The term "human," when applied to antibody polypeptides, means that the antibody polypeptide has a sequence, e.g., FR and/or CH domains, derived from a human immunoglobulin. A sequence is "derived from" a human immunoglobulin coding sequence when the sequence is either: (a) isolated from a human individual or from a cell or cell line from a human individual; (b) isolated from a library of cloned human antibody gene sequences or of human antibody variable domain sequences; or (c) diversified by mutation and selection from one or more of the polypeptides above. An "isolated" compound as used herein means that the compound is removed from at least one component with which the compound is naturally associated with in nature.

Antibody polypeptides can be administered to human patients while largely avoiding the anti-antibody immune response often provoked by the administration of antibodies from other species, e.g., mouse. For example, murine antibodies can be "humanized" by grafting murine CDRs onto a human variable domain FR, according to procedures well known in the art. Human antibodies as disclosed herein, however, can be produced without the need for genetic manipulation of a murine antibody sequence.

Variable domains may comprise one or more framework regions (FR) with the same amino acid sequence as a corresponding framework region encoded by a human germline antibody gene segment. For example, a domain antibody may comprise the $V_H$ germline gene segments DP47, DP45, or DP38, the $V_\kappa$ germline gene segment DPK9, the $J_H$ segment JH4b, or the $J_\kappa$ segment $J_\kappa 1$.

Changes may be made to antibody polypeptide sequences while retaining the ability to bind CD40 specifically. Specifically, the antibody polypeptides (e.g., a dAb) may comprise a variant variable domain that retains the function of specifically binding the same CD40 epitope as the dAb BMS3h-56-5. See TABLE 1. That is, the variant variable domain may bind a human CD40 epitope comprising at least one of Trp109, Leu121, His122, Ser124, Ser156, Ala157, Phe158, Glu159, and His162 of SEQ ID NO: 1. In one embodiment, the variant variable domain epitope may comprise Trp109, Leu121, His122, Ser124, Ser156, Ala157, Phe158, Glu159, and His162. Alternatively, the variant variable domain may specifically bind a CD40 epitope comprising CD40 residue Trp109. In yet another embodiment, the variant variable domain may compete with BMS3h-56-5 for specific binding to CD40. Error-prone affinity maturation, as disclosed in the examples below, provides one exemplary method for making and identifying antibody polypeptides with variant sequences that specifically bind the same CD40 epitope.

For example, a variant variable domain may differ from one of the variable domains listed in TABLE 3 by up to 10 amino acids or any integral value between, where the variant variable domain specifically binds CD40. Alternatively, the variant variable domain may have at least 90% sequence identity (e.g., at least 92%, 95%, or 98% sequence identity) relative to a sequence listed in the present Sequence Listing. Non-identical amino acid residues or amino acids that differ between two sequences may represent amino acid substitutions, additions, or deletions. Residues that differ between two sequences appear as non-identical positions, when the two sequences are aligned by any appropriate amino acid sequence alignment algorithm, such as BLAST.

It is provided that amino acid substitutions may be made to individual FR regions, such that one or more FR comprises up to two amino acid differences relative to the amino acid sequence of the corresponding FR encoded by a human germline antibody gene segment. It is further provided that the variant variable domain may contain one or two amino acid substitutions in one or more CDR. Representative variable domains that specifically bind CD40 are listed in TABLE 3.

ClustalW2 alignments between representative variable domains of antibody polypeptides from lineages BMS3h-56, BMS3h-37, BMS3h-38, and BMS3h-198 are shown in FIG. 4, FIG. 5, FIG. 6, and FIG. 7, respectively. As a general rule, the degree to which an amino acid is conserved in an alignment of related protein sequences is proportional to the relative importance of the amino acid position to the function of the protein. That is, amino acids that are common in all related sequences likely play an important role and cannot be easily substituted. On the other hand, positions that vary between the sequences likely can be substituted with other amino acids or otherwise modified, while maintaining the activity of the protein. The alignments shown in FIG. 4, FIG. 5, FIG. 6, and FIG. 7 and the structural relationships ascertained from FIG. 1 and FIG. 2, for example, can guide the construction of variant antibody polypeptides that specifically bind an epitope of human CD40 comprising the amino acid sequence of SEQ ID NO: 1, wherein the antibody polypeptide competes with the binding of dAb BMS3h-56-201 (SEQ ID NO: 9). Such variant antibody polypeptides include, but are not limited to, those with an amino acid modification corresponding to a substitution, insertion, or deletion with reference to any of the variable domains listed in TABLE 3. Variant antibody polypeptides also include those with an amino acid modification corresponding to an amino acid modification conserved between the sequences listed in TABLE 3.

The information regarding the boundaries of the $V_L$ or $V_H$ domains of heavy and light chain genes may be used to design PCR primers to amplify the variable domain from a cloned heavy or light chain coding sequence encoding an antibody polypeptide known to bind CD40. The amplified variable domain may be inserted into a suitable expression vector, e.g., pHEN-1 (Hoogenboom et al. (1991) *Nucleic Acids Res.* 19:4133-4137) and expressed, either alone or as a fusion with another polypeptide sequence, using techniques well known in the art. Based on the disclosed amino acid and polynucleotide sequences, the fusion protein can be produced and purified using only ordinary skill in any suitable mammalian host cell line, such as CHO, 293, COS, NSO, and the like, followed by purification using one or a combination of methods, including protein A affinity chromatography, ion exchange, reverse phase techniques, or the like.

In one aspect, the antibody polypeptide is a "dual specific" antibody polypeptide comprising a first variable domain that specifically binds human CD40 comprising the amino acid sequence of SEQ ID NO: 1. Dual specific antibody polypeptides comprise a second variable domain that specifically binds a second antigen that is other than human CD40.

In another embodiment, the second antigen may be a cell surface molecule of an immune effector cell or a soluble molecule such as a cytokine, for example. Binding of the dual specificity antibody polypeptide could be used to antagonize CD40 and antagonize a biological activity of the second antigen. Cell surface molecules of immune effector cells include the cluster of differentiation (CD) molecules. Representative CD markers are listed on the Internet at hypertext transfer protocol en.wikipedia.org/wiki/List_of_human_clusters_of_differentiation (last modified on Feb. 22, 2012). Cell surface molecules of immune effector cells also include Major Histocompatibility Complex (MHC) Class II molecules. Antibodies against these cell surface molecules are known in the art and can be used a source of a variable domain to construct a dual specific antibody polypeptide.

In one embodiment, antibody polypeptides of a dual specific ligand may be linked by an "amino acid linker" or "linker." For example, a dAb may be fused to the N-terminus of an amino acid linker, and another dAb may be fused to the C-terminus of the linker. Although amino acid linkers can be any length and consist of any combination of amino acids, the linker length may be relatively short (e.g., five or fewer amino acids) to reduce interactions between the linked domains. The amino acid composition of the linker also may be adjusted to reduce the number of amino acids with bulky side chains or amino acids likely to introduce secondary structure. Suitable amino acid linkers include, but are not limited to, those up to 3, 4, 5, 6, 7, 10, 15, 20, or 25 amino acids in length. Representative amino acid linker sequences include $(GGGGS)_n$ (SEQ ID NO: 4), where n may be any integer between 1 and 5. Other suitable linker sequences may be selected from the group consisting of AST (SEQ ID NO: 5), TVAAPS (SEQ ID NO: 6), TVA (SEQ ID NO: 7), and ASTSGPS (SEQ ID NO: 8).

The binding of the second antigen can increase the in vivo half-life of the antibody polypeptide. For example, the second variable domain of the dual specific antibody polypeptide may specifically bind serum albumin (SA), e.g., human serum albumin (HSA). The antibody polypeptide formatted to bind HSA can have an increased in vivo t-α ("alpha half-life") or t-β ("beta half-life") half-life relative to the same unformatted antibody polypeptide. The t-α and t-β half-lives measure how quickly a substance is distributed in and eliminated from the body. The linkage to HSA may be accomplished by fusion of the antibody polypeptide with a second variable domain capable of specifically binding HSA, for example. Anti-human serum albumin antibodies are well-known in the art. See, e.g., Abcam®, Human Serum Albumin antibodies ab10241, ab2406, and ab8940, available on the Internet at hypertext transfer protocol www.abcam.com/index.html, or GenWay, ALB antibody, available on the Internet at hypertext transfer protocol www.genwaybio.com. Variable domains that specifically bind HSA can be obtained from any of these antibodies, and then fused to an antibody polypeptide of the disclosure using recombinant techniques that are well known in the art.

Alternatively, the linking of the antibody polypeptide to HSA can be accomplished by directly fusing the antibody polypeptide sequence to an HSA coding sequence using techniques well known to the skilled artisan. The HSA coding sequences can be obtained by PCR using primers derived from the cDNA sequence available at GenBank Accession No. NM000477, for example.

In one embodiment, the tα-half-life of the HSA-linked domain antibody composition is increased by 10% or more. In another embodiment, the tα-half-life of the HSA-linked domain antibody composition is in the range of 0.25 hours to 6 hours. In another embodiment, the tβ-half-life of the HSA-linked domain antibody composition is increased by 10% or more. In another embodiment, the tβ-half-life of the HSA-linked domain antibody composition is in the range of 12 to 48 hours.

In another embodiment, an antibody polypeptide may be formatted to increase its in vivo half-life by PEGylation. In one embodiment, the PEG is covalently linked. In another embodiment, the PEG is linked to the antibody polypeptide at a cysteine or lysine residue. In yet another embodiment, the PEG-linked antibody polypeptide has a hydrodynamic size of at least 24 kD. In yet another embodiment, the total PEG size is from 20 to 60 kD, inclusive. In yet another embodiment, the PEG-linked domain antibody has a hydrodynamic size of at least 200 kD.

PEGylation can be achieved using several PEG attachment moieties including, but not limited to N-hydroxylsuccinimide active ester, succinimidyl propionate, maleimide, vinyl sulfone, or thiol. A PEG polymer can be linked to an antibody polypeptide at either a predetermined position, or can be randomly linked to the domain antibody molecule. PEGylation can also be mediated through a peptide linker attached to a domain antibody. That is, the PEG moiety can be attached to a peptide linker fused to an antibody polypeptide, where the linker provides the site (e.g., a free cysteine or lysine) for PEG attachment. Methods of PEGylating antibodies are well known in the art, as disclosed in Chapman, et al., "PEGylated antibodies and antibody fragments for improved therapy: a review," *Adv. Drug Deliv. Rev.* 54(4):531-45 (2002), for example.

Antibody polypeptides also may be designed to form a dimer, trimer, tetramer, or other multimer. Antibody polypeptides, e.g., dAbs, can be linked to form a multimer by several methods known in the art, including, but not limited to, expression of monomers as a fusion protein, linkage of two or more monomers via a peptide linker between monomers, or by chemically joining monomers after translation, either to each other directly, or through a linker by disulfide bonds, or by linkage to a di-, tri- or multivalent linking moiety (e.g., a multi-arm PEG). In one embodiment, the multimer can bind a single molecule of CD40.

4. Pharmaceutical Compositions and Methods of Treatment

A pharmaceutical composition comprises a therapeutically-effective amount of one or more antibody polypeptides and optionally a pharmaceutically acceptable carrier. Pharmaceutically acceptable carriers include, for example, water, saline, phosphate buffered saline, dextrose, glycerol, ethanol and the like, as well as combinations thereof. Pharmaceutically acceptable carriers can further comprise minor amounts of auxiliary substances, such as wetting or emulsifying agents, preservatives, or buffers that enhance the shelf-life or effectiveness of the fusion protein. The compositions can be formulated to provide quick, sustained, or delayed release of the active ingredient(s) after administration. Suitable pharmaceutical compositions and processes for preparing them are well known in the art. See, e.g., Remington, THE SCIENCE AND PRACTICE OF PHARMACY, A. Gennaro, et al., eds., 21st ed., Mack Publishing Co. (2005).

The pharmaceutical composition further may comprise an immuno-suppressive/immunomodulatory and/or anti-inflammatory agent. A method of treating an immune disease in a patient in need of such treatment may comprise administering to the patient a therapeutically effective amount of the pharmaceutical composition. Antagonizing CD40-mediated T cell activation could inhibit undesired T cell responses occurring during autoimmunity, transplant rejection, or allergic responses, for example. Inhibiting CD40-mediated T cell activation could moderate the progression and/or severity of these diseases.

As used herein, a "patient" means an animal, e.g. mammal, including humans. The patient may be diagnosed with an immune disease. "Treatment" or "treat" or "treating" refers to the process involving alleviating the progression or severity of a symptom, disorder, condition, or disease. An "immune disease" refers to any disease associated with the development of an immune reaction in an individual, including a cellular and/or a humoral immune reaction. Examples of immune diseases include, but are not limited to, inflammation, allergy, autoimmune disease, or graft-related disease. The autoimmune disease may be selected from the group consisting of systemic lupus erythematosus, multiple sclerosis, rheumatoid arthritis, diabetes, psoriasis, scleroderma, atherosclerosis, inflammatory bowel disease, and ulcerative colitis.

Diseases that can be treated by administering the pharmaceutical composition may be selected from the group consisting of Addison's disease, allergies, ankylosing spondylitis, asthma, atherosclerosis, autoimmune diseases of the ear, autoimmune diseases of the eye, autoimmune hepatitis, autoimmune parotitis, colitis, coronary heart disease, Crohn's disease, diabetes, including Type 1 and/or Type 2 diabetes, epididymitis, glomerulonephritis, Graves' disease, Guillain-Barre syndrome, Hashimoto's disease, hemolytic anemia, idiopathic thrombocytopenic purpura, inflammatory bowel disease, immune response to recombinant drug products (e.g., Factor VII in hemophiliacs), systemic lupus erythematosus, male infertility, multiple sclerosis, myasthenia gravis, pemphigus, psoriasis, rheumatic fever, rheumatoid arthritis, sarcoidosis, scleroderma, Sjogren's syndrome, spondyloarthropathies, thyroiditis, transplant rejection, and vasculitis. Autoimmune-mediated conditions include, but are not limited to, conditions in which the tissue affected is the primary target, and in some cases, the secondary target. Such conditions include, but are not limited to, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus' phenomenon, anaphylaxis, alcohol addiction, and drug addiction.

The pharmaceutical composition may be administered alone or in combination therapy, (i.e., simultaneously or sequentially) with an immunosuppressive/immunomodulatory and/or anti-inflammatory agent. Different immune diseases can require use of specific auxiliary compounds useful for treating immune diseases, which can be determined on a patient-to-patient basis. For example, the pharmaceutical composition may be administered in combination with one or more suitable adjuvants, e.g., cytokines (IL-10 and IL-13, for example) or other immune stimulators, e.g., chemokines, tumor-associated antigens, and peptides. Suitable adjuvants are known in the art.

Any suitable method or route can be used to administer the antibody polypeptide or the pharmaceutical composition. Routes of administration include, for example, oral, intravenous, intraperitoneal, subcutaneous, or intramuscular administration. A therapeutically effective dose of administered antibody polypeptide(s) depends on numerous factors, including, for example, the type and severity of the immune disease being treated, the use of combination therapy, the route of administration of the antibody polypeptide(s) or pharmaceutical composition, and the weight of the patient. A non-limiting range for a therapeutically effective amount of a domain antibody is 0.1-20 mg/kg, and in an aspect, 1-10 mg/kg, relative to the body weight of the patient. The dose of antibody polypeptide(s) can be further guided by the amount of antibody polypeptide(s) required for CD40 antagonism in in vitro and/or in vivo models of disease states. Representative models are described below and in the examples.

5. In Vitro and In Vivo Models

The ability of antibody polypeptides of the disclosure to antagonize CD40 can be tested in one of several available in vitro or in vivo model systems. Appropriate animal and cell model systems are described below. Further cell assay systems are described in the examples.

5.1. Inflammatory Bowel Disease (IBD) Models:

IBD is a multifactorial immune disorder of uncertain etiology. Several mouse models of mucosal inflammation that resemble IBD have provided insight into the mechanisms governing both normal and pathological mucosal immune function. IBD models include using the mucosal immunity and inflammation system of De Winter et al., *Am. J. Physiol.* 276: G1317-1321 (1999). In one aspect, the injection into immunodeficient mice of a subset of CD4(+) T lymphocytes, the CD4(+)CD45RBhigh cells, leads to inflammation of the intestine. Pathogenesis is due in part to the secretion of proinflammatory cytokines. The induction of colitis can be prevented by co-transfer of another CD4(+) subpopulation, the CD4(+)CD45RBlow T cells. This population behaves analogously to the CD4(+)CD45RBhigh population in terms of the acquisition of activation markers and homing to the host intestine. However, their lymphokine profile when activated is different, and anti-inflammatory cytokines secreted and/or induced by CD4(+)CD45RBlow T cells prevent colitis. De Winter et al. provide a description of the adoptive transfer model and the factors that promote and prevent colitis pathogenesis.

5.2. Spontaneous Arthritis Models:

A model of organ-specific disease provoked by systemic autoimmunity is provided by Kouskoff et al., *Cell* 87: 811-822 (1996). Rheumatoid arthritis (RA) is a chronic joint disease characterized by leukocyte invasion and synoviocyte activation followed by cartilage and bone destruction. Kouskoff et al. disclose a spontaneous mouse model of RA, generated by crossing a T cell receptor (TCR) transgenic line with the NOD strain. All offspring develop a joint disease highly reminiscent of RA in man. The trigger for the murine disorder is chance recognition of a NOD-derived major histocompatibility complex (MHC) class II molecule by the transgenic TCR; progression to arthritis involves CD4+ T, B, and probably myeloid cells.

5.3. Collagen Induced Arthritis (CIA) Model:

A mouse model of collagen-induced arthritis is provided by Brand et al., *Methods Mol. Med.* 102: 295-312 (2004). Collagen-induced arthritis (CIA) is an autoimmune disease that can be elicited in susceptible strains of rodents (rat and mouse) and non-human primates by immunization with type II collagen (CII), the major constituent protein of articular cartilage. After immunization, the animals develop an autoimmune polyarthritis that shares several clinical and histological features with RA. Susceptibility to CIA in rodents is linked to the class II molecules of the major histocompatibility complex (MHC), and the immune response to CII is characterized by both the stimulation of collagen-specific T cells and the production of high titers of antibody specific for both the immunogen (heterologous CII) and the autoantigen (mouse CII). Histologically, murine CIA is characterized by an intense synovitis that corresponds with the clinical onset of arthritis. This experimental data is useful evaluating CIA because of the pathological similarities between CIA and RA.

5.4. Antigen Induced T Cell Proliferation In Vivo Model:

The use of adoptive transfer of T cell receptor (TCR)-transgenic T cells provides an in vivo model for antigen-induced T-cell proliferation. Pape et al., *Immunol. Rev.* 156: 67-78 (1997) discloses adoptive transfer of TCR-transgenic T cells uniformly expressing an identifiable TCR of a known peptide/MHC specificity. The model can be used to monitor the in vivo behavior of antigen-specific T cells. Naive T cells are initially activated within T-cell zones of secondary lymphoid tissue to proliferate in a B7-dependent manner. If adjuvants or inflammatory cytokines are present during this period, enhanced numbers of T cells accumulate, migrate into B-cell-rich follicles, and acquire the capacity to produce IFN-γ and help B cells produce IgG2a. If inflammation is effectively antagonized, most of the initially activated antigen-specific T cells disappear without entering the follicles, and the survivors are poor producers of IL-2 and IFN-γ.

EXAMPLES

TABLE 3 lists representative anti-human CD40 variable domain amino acid sequences useful for the antibody polypeptides of the disclosure. TABLE 4 discloses representative nucleic acids that encode the variable domain sequences listed in TABLE 3. As is well known in the art, multiple codons can encode the same amino acid. Nucleic acids encoding a protein sequence thus include nucleic acids having codon degeneracy. The antibody polypeptides disclosed in TABLE 3 specifically bind CD40 and were made using the reiterative initial/primary screening and affinity maturation methodologies described in the examples that follow.

TABLE 3

Anti-Human CD40 Variable Domain Amino Acid Sequences

BMS3h-56-201
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFYFQEWGQGTLVTVSS (SEQ ID NO: 9)

BMS3h-56-258
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFYFHEWGQGTLVTVSS (SEQ ID NO: 10)

BMS3h-37
EVQLLESGGGLVQPGGSLRLSCAASGFTFEWYEMQWVRQAPGKGLEWVSAISGDGYRTYYADSVKGRFTISRDNSKNTL
YLQMNSLRAEDTAVYYCAKELGYFDYWGQGTLVTVSS (SEQ ID NO: 11)

BMS3h-38
EVQLLESGGGLVQPGGSLRLSCAASGFTFEEEEMIWVRQAPGKGLEWVSAISGSGGSTYYADSVKGRFTISRDNSKNTL
YLQMNSLRAEDTAVYYCAKEPFRFDYWGQGTLVTVSS (SEQ ID NO: 12)

BMS3h-41
EVQLLESGGGLVQPGGSLRLSCAASGFTFTEYEMIWVRQAPGKGLEWVSSISGNGANTYYADSVKGRFTISRDNSKNTL
YLQMNSLRAEDTAVYYCAKEPLRFDYWGQGTLVTVSS (SEQ ID NO: 13)

BMS3h-43
EVQLLESGGGLVQPGGSLRLSCTASGFTFNMYEMSWVRQAPGKGLEWVSGISRRGFTTYYADSVKGRFTISRDNSKNTL
YLQMNSLRAEDTAVYYCAKEPITYAMRYARFDYWGQGTLVTVSS (SEQ ID NO: 14)

BMS3h-56
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFIFDYWGQGTLVTVSS (SEQ ID NO: 15)

BMS3h-106
EVQLLESGGGLVQPGGSLRLSCAASGFTFSTYHMQWVRQAPGKGLEWVSMIDADGLGTYYADSVKGRFTISRDNSKNTL
YLQMNSLRAEDTAVYYCAKPGPQFGQFDYWGQGTLVTVSS (SEQ ID NO: 16)

BMS3h-107
EVQLLESGGGLVQPGGSLRLSCAASGFTFSGYDMQWVRQAPGKGLEWVSTISASGVFTYYADSVKGRFTTSRDNSKNTL
YLQMNSLRAEDTAVYYCAKYPNRFALNNFDYWGQGTLVTVSS (SEQ ID NO: 17)

BMS3h-131
DIQMTQSPSSLSASVGDRVTITCRANSSILWALAWYQQKPGKAPKLLIESSSGLQSGVPSRFSGSGSGTDFTLTISSLQ
PEDFATYYCVQNAGWPGTFGQGTKVEIKR (SEQ ID NO: 18)

BMS3h-193
DIQMTQSPSSLSASVGDRVTITCRASQTIERRLNWYQQKPGKAPKLLIYLASRLQSGVPSRFSGSGSGTDFTLTISSLQ
PEDFATYYCHQYASPPLTFGQGTKVEIKR (SEQ ID NO: 19)

BMS3h-198
EVQLLESGGGLVQPGGSLRLSCAASGFTFAGYEMWWVRQAPGKGLERVSAISGSGGSTYYADSVKGRFTISRDDSKNTL
YLQMNSLRAEDTAVYYCAKDPYSFDYWGQGTLVTVSS (SEQ ID NO: 20)

BMS3h-202
EVQLLESGGGLVQPGGSLRLSCAASGFTFPTAEMVWVRQAPGKGLEWVSSISASGGSTYYADSVKGRFTISRDNSKNTL
YLQMNSLRAEDTAVYYCAKEPVSYVATFDYWGQGTLVTVSS (SEQ ID NO: 21)

TABLE 3-continued

Anti-Human CD40 Variable Domain Amino Acid Sequences

BMS3h-217
DIQMTQSPSSLSASVGDRVTITCRASHFIGTLLLSWYQQKPGKAPKLLITYGSLLQSGVPSRFSGSGSGTDFTLTISSLQ
PEDFATYYCGQGVLWPATFGQGTKVEIKR (SEQ ID NO: 22)

BMS3h-1
EVQLLESGGGLVQPGGSLRLSCAASGFTFPKNEMTWVRQAPGKGLEWVSAIESDGQATYYADSVKGRFTISRDNSKNTL
YLQMNSLRAEDTAVYYCAKNRIPDLVFDYWGQGTLVTVSS (SEQ ID NO: 23)

BMS3h-2
EVQLLESGGGLVQPGGSLRLSCAASGFTFDAGAMTWVRQAPGKGLEWVSSIDKEGLSTYYADSVKGRFTISRDNSKNTL
YLQMNSLRAEDTAVYYCAKGRIPGLVFDYWGQGTLVTVSS (SEQ ID NO: 24)

BMS3h-3
EVQLLESGGGLVQPGGSLRLSCAASGFTFGDAAMTWVRQAPGKGLEWVSAIQPMGDGTYYADSVKGRFTVSRDNSKNTL
YLQMNSLRAEDTAVYYCAKGRIPTLQFDYWGQGTLVTVSS (SEQ ID NO: 25)

BMS3h-4
EVQLLESGGGLVQPGGSLRLSCAASGFTFEDSPMTWVRQAPGKGLEWVSAITSNGYETYYADSVKGRFTISRDNSKNTL
YLQMNSLRAEDTAVYYCAKGRIPTLHFDYWGQGTLVTVSS (SEQ ID NO: 26)

BMS3h-5
EVQLLESGGGLVQPGGSLRLSCAASGFTFDEHDMSWVRQAPGKGLEWVSRIGPDGFHTYYADSVKGRFTISRDNSKNTL
YLQMNSLRAEDTAVYYCAKGRIPTLHFDYWGQGTLVTVSS (SEQ ID NO: 27)

BMS3h-6
EVQLLESGGGLVQPGGSLRLSCAASGFTFGEYHMSWVRQAPGKGLEWVSRITPLGTLTYYADSVKGRFTISRDNSKNTL
YLQMNSLRAEDTAVYYCAKGRIPSLTFDYWGQGTLVTVSS (SEQ ID NO: 28)

BMS3h-7
EVQLLESGGGLVQPGGSLRLSCAASGFTFGTNAMSWVRQAPGKGLEWVSRISPGGDYTYYADSVKGRFTISRDNSKNTL
YLQMNSLRAEDTAVYYCAKGRVPDLLFDYWGQGTLVTVSS (SEQ ID NO: 29)

BMS3h-8
EVQLLESGGGLVQPGGSLRLSCAASGFTFPSEEMSWVRQAPGKGLEWVSRISADGANTYYADSVKGRFTISRDNSKNTL
YLQMNSLRAEDAAVYYCAKGRVPDLLFDYWGQGTLVTVSS (SEQ ID NO: 30)

BMS3h-9
EVQLLESGGGLVQPGGSLRLSCAASGFTFAEDDMTWVRQAPGKGLEWVSRIAVDGDRTYYADSVKGRFTISRDNSKNTL
YLQMNSLRAEDTAVYYCAKGKVPSLHFDYWGQGTLVTVSS (SEQ ID NO: 31)

BMS3h-10
EVQLLESGGGLVQPGGSLRLSCAASGFTFRTMDMSWVRQAPGKGLEWVSRITGDGMNTYYADSVKGRFTISRDNSKNTL
YLQMNSLRAGDTAVYYCAKGVTPDLTFDYWGQGTLVTVSS (SEQ ID NO: 32)

BMS3h-11
EVQLLESGGGLVQPGGSLRLSCAASGFTFERDDMTWVRQAPGKGLEWVSRINAGGVHTYYADSVKGRFTISRDNSKNTL
YLQMNSLRAEDTAVYYCAKGVTPDLTFDYWGQGTLVTVSS (SEQ ID NO: 33)

BMS3h-12
EVQLLESGGGLVQPGGSLRLSCAASGFTFDDDSMTWVRQAPGKGLEWVSRISSDGASTYYADSVKGRFTISRDNSKNTL
YLQMNSLRAEDTAVYYCAKGVTPDLTFDYWGQGTLVTVSS (SEQ ID NO: 34)

BMS3h-13
EVQLLESGGGLVQPGGSLRLSCAASGFTFTEEDMTWVRQAPGKGLEWVSRIDSVGEGTYYADSVKGRFTISRDNSKNTL
YLQMNSLRAEDTAVYYCAKGVTPDLTFDYWGQGTLVTVSS (SEQ ID NO: 35)

BMS3h-14
EVQLLESGGGLVQPGGSLRLSCAASGFTFSDSAMSWVRQAPGKGLEWVSRIDNPGQHTYYADSVKGRFTISRDNSKNTL
YLQMNSLRAEDTAVYYCAKGTVPTLEFDYWGQGTLVTVSS (SEQ ID NO: 36)

BMS3h-15
EVQLLESGGGLVQPGGSLRLSCAASGFTFGQHSMTWVRQAPGKGLEWVSRIDGGGYNTYYADSVKGRFTISRDNSKNTL
YLQMNSLRAEDTAVYYCAKGEVPRLHFDYWGQGTLVTVSS (SEQ ID NO: 37)

BMS3h-16
EVQLLESGGGLVQPGGSLRLSCAASGFTFGQEPMTWVRQAPGKGLEWVSRIAYNGGDTYYADSVKGRFTISRDNSKNTL
YLQMNSLRAEDTAVYYCAKGITPNLTFDYWGQGTLVTVSS (SEQ ID NO: 38)

BMS3h-17
EVQLLESGGGLVQPGGSLRLSCAASGFTFENYPMSWVRQAPGKGLEWVSRINATGSITYYADSVKGRFTISRDNSKNTL
YLQMNSLRAEDTAVYYCAKGVIPHLMFDYWGQGTLVTVSS (SEQ ID NO: 39)

BMS3h-18
EVQLLESGGGLVQPGGSLRLSCAASGFTFRDYDMSWVRQAPGKGLEWVSRITGTGNSTYYADSVKGRFTISRDNSKNTL
YLQMNSLRAEDTAVYYCAQGVVPYLAFDYWGQGTLVTVSS (SEQ ID NO: 40)

TABLE 3-continued

Anti-Human CD40 Variable Domain Amino Acid Sequences

BMS3h-19
EVQLLESGGGLVQPGGSLRLSCAASGFTFEADAMTWVRQAPGKGLEWVSRINVDGDRTYYADSVKGRFTISRDNSKNTL
YLQMNSLRAEDTAVYYCAKGTVPTLEFDYWGQGTLVTVSS (SEQ ID NO: 41)

BMS3h-21
EVQLLESGGGLVQPGGSLRLSCAASGFTFDRADMTWVRQAPGKGLEWVSRISGEGKCTYYADSVKGRFTISRDNSKNTL
YLQMNSLRAEDTAVYYCAKGMVPNLVFDYWGQGTLVTVSS (SEQ ID NO: 42)

BMS3h-22
EVQLLESGGGLVQPGGSLRLSCAASGFTFHWEPMSWVRQAPGKGLEWVSRINSSGWDTYYADSVKGRFTISRDNSKNTL
YLQMNSLRAEDTAVYYCAKGMVPNLVFDYWGQGTLVTVSS (SEQ ID NO: 43)

BMS3h-24
EVQLLESGGGLVQPGGSLRLSCAASGFTFADEPMTWVRQAPGKGLEWVSRIPPEGAPTYYADSVKGRFTISRDNSKNTL
YLQMNSLRAEDTAVYYCAKGITPNLTFDYWGQGTLVTVSS (SEQ ID NO: 44)

BMS3h-26
EVQLLESGGGLVQPGGSLRLSCAASGFTFHNHDMSWVRQAPGKGLEWVSRISRGGLQTYYADSVKGRFTISRDNSKNTL
YLQMNSLRAEDTAVYYCAKGIVPDLHFDYWGQGTLVTVSS (SEQ ID NO: 45)

BMS3h-27
EVQLLESGGGLVQPGGSLRLSCAASGFTFNEYPMSWVRQAPGKGLEWVSRINGDGANTYYADSVKGRFTISRDNSKNTL
YLQMNSLRAEDTAVYYCAKGIIPAMQFDYWGQGTLVTVSS (SEQ ID NO: 46)

BMS3h-28
EVQLLESGGGLVQPGGSLRLSCAASGFTFGDVPMSWVRQAPGKGLEWVSRIDPYGSNTYYADSVKGRFTISRDNSKNTL
YLQMNSLRAEDTAVYYCAKGIMPSLTFDYWGQGTLVTVSS (SEQ ID NO: 47)

BMS3h-29
EVQLLESGGGLVQPGGSLRLSCAASGFTFADYDMSWVRQAPGKGLEWVSRISALGATTYYADSVKGRFTISRDNSKNTL
YLQMNSLRAEDTAVYYCAKGQLPALEFDYWGQGTLVTVSS (SEQ ID NO: 48)

BMS3h-30
EVQLLESGGGLVQPGGSLRLSCAASGFTFKRYYMTWVRQAPGKDLEWVSGIVPSGNRTYYADSVKGRFTISRDNSKNTL
YLQMNSLRAEDTAVYYCAKGRIPDLHFDYWGQGTLVTVSS (SEQ ID NO: 49)

BMS3h-31
EVQLLESGGGLVQPGGSLRLSCAASGFTFADYDMTWVRQAPGKGLEWVSRISPTGGQTYYADSVKGRFTISRDNSKNTL
YLQMNSLRAEDTAVYYCAKGVIPYLSFSPFDYWGQGTLVTVSS (SEQ ID NO: 50)

BMS3h-32
EVQLLESGGGLVQPGGSLRLSCAASGFTFSKYWMGWARQAPGKGLEWVSSIDSHGAGTYYADSVKGRFTISRDNSKNTL
YLQMNSLRVEDTAVYYCAKGAPKFMTTYTFDYWGQGTLVTVSS (SEQ ID NO: 51)

BMS3h-33
EVQLLESGGGLVQPGGSLRLSCAASGFTFLSYPMHWVRQAPGKGLEWVSSIDSRGSVTYYADSVKGRFTISRDNSKNTL
YLQMNSLRAEDTAVYYCAKGHSWTFDYWGQGTLVTVSS (SEQ ID NO: 52)

BMS3h-34
EVQLLESGGGLVQPGGSLRLSCAASGFTFANSNMTWVRQAPGKGLEWVSRINPDGGSTYYADSVKGRFTISRDNSKNTL
YLQMNSLRAEDTAVYYCAEGRIPTLHFDYWGQGTLVTVSS (SEQ ID NO: 53)

BMS3h-35
EVQLLESGGGLVQPGGSLRLSCAASGFTFGPRRMGWVRQAPGKGLEWVSSIDDIGRRTYYADSVKGRFTISRDNSKNTL
YLQMNSLRAEDTAVYYCAEGAQGVLLFDYWGQGTLVTVSS (SEQ ID NO: 54)

BMS3h-36
EVQLLESGGGLVQPGGSLRLSCAASGFTFEDYRMVWVRQAPGKGLEWVSSISTSGELTYYADSVKGRFTISRDNSKNTL
YLQMNSLRAEDTAVYYCAETAGQFFDYWGQGTLVTVSS (SEQ ID NO: 55)

BMS3h-39
EVQLLESGGGLVQPGGSLRLSCAASGFTFPEYEMVWVRQAPGKGLEWVSAISREGRATYYADSVKGRFTISRDNSKNTL
YLQMNNLRAEDTAVYYCAKEPVRFDYWGQGTLVTVSS (SEQ ID NO: 56)

BMS3h-40
EVQLLESGGGLVQPGGSLRLSCAASGFTFSTYEMLWVRQAPGKGLEWVSSISSSGNYTYYADSVKGRFTISRDNSKNTL
YLQMNSLRAEDTAVYYCAKEPLMFDYWGQGTLVTVSS (SEQ ID NO: 57)

BMS3h-42
EVQLLESGGGLVQPGGSLRLSCAASGFTFDTEEMSWVRQAPGKGLEWVSAISPNGAFTFYADSVKGRFTISRDNSKNTL
YLQMNSLRAEDTAVYYCAKEPILFDYWGQGTLVTVSS (SEQ ID NO: 58)

BMS3h-44
EVQLLESGGGLVQPGGSLRLSCAASGFTFGHYDMVWVRQAPGRGLEWVSTINGAGLNTYYADSVKGRFTISRDNSKNTL
YLQMNSLRAEDTAVYYCAQSASRIFDYWGQGTLVTVSS (SEQ ID NO: 59)

TABLE 3-continued

Anti-Human CD40 Variable Domain Amino Acid Sequences

BMS3h-45
EVQLLESGGGLVQPGGSLRLSCAASGFTFRSYEMAWVRQAPGKGLEWVSSISTLGTKTYYADSVKGRFTISRDNSKNTL
YLQMNSLRAEDTAVYYCAQSSTHIFDYWGQGTLVTVSS (SEQ ID NO: 60)

BMS3h-46
EVQLLESGGGLVQPGGSLRLSCAASGFTFIRYEMAWVRQAPGKGLEWVSSISSSGWTTYYADSVKGRFTISRDNSKNTL
YLQMNSLRAEDTAVYYCAKSDAHIFDYWGQGTLVTVSS (SEQ ID NO: 61)

BMS3h-47
EVQLLESGGGLVQPGGSLRLSCAASGFTFYAYEMAWVRQAPGKGLEWVSSISDDGTRTYYADSVKGRFTISRDNSKNTL
YLQMNSLRAEDTAVYYCAKDLGQGFDYWGQGTLVTVSS (SEQ ID NO: 62)

BMS3h-48
EVQLLESGGGLVQPGGSLRLSCAASGFTFADHGMTWVRQAPGKGLEWVSGIGPSGEATYYADSVKGRFTISRDNSKNTL
YLQMNSLRAEDTAVYYCAKDRIPNLVFDYWGQGTLVTVSS (SEQ ID NO: 63)

BMS3h-49
EVQLLESGGGLVQPGGSLRLSCAASGFTFESQDMSWVRQAPGKGLEWVSGISPNGWDTYYADSVKGRFTISRDNSKNTL
YLQMNSLRAEDTAVYYCAKDRSDFDYWGQGTLVTVSS (SEQ ID NO: 64)

BMS3h-50
EVQLLESGGGLVQPGGSLRLSCAASGFTFGDYDMWWVRQAPGKGLEWVSRIRHPGGVTYYADSVKGRFTISRDNSKNTL
YLQMNSLRAEDTAVYYCAKAVPKGFDYWGQGTLVTVSS (SEQ ID NO: 65)

BMS3h-51
EVQLLESGGGLVQPGGSLRLSCAASGFTFRVYWMTWVRQAPGKGLEWVSSIDPQGGMTYYADSVKGRFTISRDNSKNTL
YLQMNSLRAEDTAVYYCAKARIPNLEFDYWGQGTLVTVSS (SEQ ID NO: 66)

BMS3h-52
EVQLLESGGGLVQPGESLRLSCAASGFTFSAYDMTWVRQAPGKGLEWVSRINPTGSYTYYADSVKGRFTISRDNSKNTL
YLQMNSLRAEDTAVYYCAKAKIPNLVFDYWGQGTLVTVSS (SEQ ID NO: 67)

BMS3h-53
EVQLLESGGGLVQPGGSLRLSCAASGFTFADSEMMWVRQAPGKGLEWVSGIAHNGGHTYYADSVKGRFTISRDNSKNTL
YLQMNSLRAEDTAVYYCAKAGHPQQTEAFDYWGQGTLVTVSS (SEQ ID NO: 68)

BMS3h-54
EMQLLESGGGLVQPGGSLRLSCAASGFTFATYDMYWVRQAPGKGLEWVSKISPNGWSTYYADSVKGRFTISRDNSKNTL
YLQMNSLRAEDTAVYYCAKYQTHFDYWGQGTLVTVSS (SEQ ID NO: 69)

BMS3h-55
EVQLLESGGGLVQPGGSLRLSCAASGFTFSVYDMRWVRQAPGKGLEWVSTISSSGTYTYYADSVKGRFTISRDNSKNTL
YLQMNSLRAEDTAVYYCAKYPKNFDYWGQGTLVTVSS (SEQ ID NO: 70)

BMS3h-57
EVQLLESGGGLVQPGGSLRLSCAASGFTFSHEDMTWVRQAPGKGLEWVSSISPNGWDTYYADSVKGRFTISRDNSKNTL
YLQMNSLRAEDTAVYYCAKRTRSKFDYWGQGTLVTVSS (SEQ ID NO: 71)

BMS3h-58
EVQLLESGGGLVQPGGSLRLSCAASGFTFEKYIMGWARQAPGKGLEWVSTIDYWGQHTYYADSVKGRFTISRDNSKNTL
YLQMNSLRAEDTAVYYCAKRSHLIPLQFDYWGQGTLVTVSS (SEQ ID NO: 72)

BMS3h-59
EVQLLESGGGLVQPGGSLRLSCAASGFTFSDYAMGWVRQAPGKGLEWVSTISYVGYYTYYADSVKGRFTISRDNSKNTL
YLQMNSLRAEDTAVYYCAKKALRGEAFTERFDYWGQGTLVTVSS (SEQ ID NO: 73)

BMS3h-60
EVQLLESGGGLVQPGGSLRLSCAASGFTFGPYMMHWVRQAPGKGLEWVSTIEVNGNRTYYADSVKGRFTISRDNSKNTL
YLQMNSLRAEDTAVYYCAKWVGSKTSSDKSFDYWGQGTLVTVSS (SEQ ID NO: 74)

BMS3h-61
EVQLLESGGGLVQPGGSLRLSCAASGFTFGTTEMAWVRQAPGKGLEWVSSIGSAGAWTYYADSVKGRFTISRDNSKNTL
YLQMNSLRAEDTAVYYCAKIGGHPQGQFDYWGQGTLVTVSS (SEQ ID NO: 75)

BMS3h-62
EVQLLESGGGLVQPGGSLRLSCAASGFTFPREWMAWVRQAPGKGLEWVSSIQPMGQTTYYADSVKGRFTISRDNSKNTL
YLQMNSLRAEDTAVYYCAKYSRNKGFFDYWGQGTLVTVSS (SEQ ID NO: 76)

BMS3h-63
EVQLLESGGGLVQPGGSLRLSCAASGFTFTSEYMGWVRQAPGKGLEWVSSIQRYGSTTYYADSVKGRFTISRDNSKNTL
YLQMNSLRAEDTAVYYCAKHESNWETFDYWGQGTLVTVSS (SEQ ID NO: 77)

BMS3h-70
EVQLLESGGGLVQPGGSLRLSCAASGFTFSVYSMQWVRQAPGKGLEWVSAITPNGTRTYYADSVKGRFTISRDNSKNTL
YLQMNSLRAEDTAVYYCAKTLGRGSYPGVDFDYWGQGTLVTVSS (SEQ ID NO: 78)

TABLE 3-continued

Anti-Human CD40 Variable Domain Amino Acid Sequences

BMS3h-71
EVQLLESGGGLVQPGGSLRLSCAASGFTFPSYAMTWVRQAPGKGLEWVSRITADGTVTYYADSVKGRFTISRDNSKNTL
YLQMNSLRAEDTAVYYCAKGSIPMLTFDYWGQGTLVTVSS (SEQ ID NO: 79)

BMS3h-72
EVQLLESGGGLVQPGGSLRLSCAASGFTFSTYDMIWVRQAPGKGLEWVSAISPNGTGIYYADSVKGRFTISRDNSKNTL
YLQMNSLRAEDTAVYYCAKNQSVHHAVFDYWGQGTLVTVSS (SEQ ID NO: 80)

BMS3h-73
EVQLLESGGGLVQPGGSLRLSCAASGFTFENYEMTWVRQAPGKGLEWVSRIAPHGRLTYYADSVKGRFTISRDNSKNTL
YLQMNSLRAEDTAVYYCAKGQIPMLDFDYWGQGTLVTVSS (SEQ ID NO: 81)

BMS3h-74
EVQLLESGGGLVQPGGSLRLSCAASGFTFSHYMMMWVRQAPGKGLEWVSTISHFGDITYYADSVKGRFTISRDNSKNTL
YLQMNSLRAEDTAVYYCAKNDMVMKNGGFDYWGQGTLVTVSS (SEQ ID NO: 82)

BMS3h-75
EVQLLESGGGLVQPGGSLRLSCAASGFTFERYDMSWVRQAPGKGLEWVSRIDSRGWSTYYADSVKGRFTISRDNSKNTL
YLQMNSLRAEDTAVYYCAKGLVPHLRFDYWGQGTLVTVSS (SEQ ID NO: 83)

BMS3h-76
EVQLLESGGGLVQPGGSLRLSCAASGFTFANAQMTWVRQAPGKGLEWVSRIDAMGDATYYADSVKGRFTISRDNSKNTL
YLQMNSLRAEDTAVYYCAKGKVPSIDYWGQGTLVTVSS (SEQ ID NO: 84)

BMS3h-77
EVQLLESGGGLVQPGGSLRLSCAASGFTFANAQMTWVRQAPGKGLEWVSRIDAMGDATYYADSVKGRFTISRDNSKNTL
YLQMNSLRAEDTAVYYCAKGVIPAFDYWGQGTLVTVSS (SEQ ID NO: 85)

BMS3h-78
EVQLLESGGGLVQPGGSLRLSCAASGFTFQNDRMHWVRQAPGKGLEWVSSISATGGDTYYADSVKGRFTISRDNSKNTL
YLQMNSLRAEDTAVYYCAKQTGTNRFDYWGQGTLVTVSS (SEQ ID NO: 86)

BMS3h-79
EVQLLESGGGLVQPGGSLRLSCAASGFTFNQPYMSWVRQAPGKGLEWVSSIDASGGTTYYADSVKGRFTISRDNSKNTL
YLQMNSLRAEDAAVYYCAKDRIPNLVFDYWGQGTLVTVSS (SEQ ID NO: 87)

BMS3h-80
EVQLLESGGGLVQPGGSLRLSCAASGFTFDNENMTWVRQAPGKGLEWVSRIDGGGYNTYYADSVKGRFTISRDNSKNTL
YLQMNSLRAEDTAVYYCAKGQVPELLFDYWGQGTLVTVSS (SEQ ID NO: 88)

BMS3h-81
EVQLLESGGGLVQPGGSLRLSCAASGFTFVSSNMTWVRQAPGKGLEWVSAISGSGGSTYYADSVKGRFTISRDNSKNTL
YLQMNSLRAEDTAVYYCAKGRIPTLVFDYWGQGTLVTVSS (SEQ ID NO: 89)

BMS3h-82
EVQLLESGGGLVQPGGSLRLSCAASGFTFVSSNMTWVRQAPGKGLEWVSAISGSGGSTYYADSVKGRFTISRDNSKNTL
YLQMNSLRAEDTAVYYCAKDRIPNLVFDYWGQGTLVTVSS (SEQ ID NO: 90)

BMS3h-83
EVQLLESGGGLVQPGGSLRLSCAASGFTFSDDSMSWVRQAPGKGLEWVSRINDAGSSTYYADSVKGRFTISRDNSKNTL
YLQMNSLRAEDTAVYYCAKGTIPLLEFDYWGQGTLVTVSS (SEQ ID NO: 91)

BMS3h-84
EMQLLESGGGLVQPGGSLRLSCAASGFTFVSDTMSWVRQAPGKGLEWVSRIDGTGGDTYYADSVKGRFTISRDNSKNTL
YLQMNSLRAGDTAVYYCAKGLIPDLQFDYWGQGTLVTVSS (SEQ ID NO: 92)

BMS3h-85
EVQLLESGGGLVQPGGSLRLSCAASGFTFDEEEMTWVRQAPGKGLEWVSRIIGGGHETYYADSVKGRFTISRDNSKNTL
YLQMNSLRAEDTAVYYCAKGTIPLLEFDYWGQGTLVTVSS (SEQ ID NO: 93)

BMS3h-86
EVQLLESGGGLVQPGGSLRLSCAASGFTFDNENMTWVRQAPGKDLEWVSRITERGDVTYYADSVKGRFTISRDNSKNTL
YLQMNSLRAEDTAVYYCAKGTVPTLEFDYWGQGTLVTVSS (SEQ ID NO: 94)

BMS3h-87
EVQLLESGGGLVQPGGSLRLSCAASGFTFDEEEMTWVRQAPGKGLEWVSRIIGGGHETYYADSVKGRFTISRDNSKNTL
YLQMNSLRAEDTAVYYCAKGTVPTLEFDYWGQGTLVTVSS (SEQ ID NO: 95)

BMS3h-88
EVQLLESGGGLVQPGGSLRLSCAASGFTFHETEMTWVRQAPGKGLEWVSAINRLGQDTYYADSVKGRFTISRDNSKNTL
YLQMNSLRAEDTAVYYCAKGRIPGLVFDYWGQGTLVTVSS (SEQ ID NO: 96)

BMS3h-89
EVQLLESGGGLVQPGGSLRLSCAASGFTFSDDSMSWVRQAPGKGLEWVSRINDAGSSTYYADSVKGRFTISRDNSKNTL
YLQMNSLRAEDTAVYYCAKGTVPTLEFDYWGQGTLVTVSS (SEQ ID NO: 97)

TABLE 3-continued

Anti-Human CD40 Variable Domain Amino Acid Sequences

BMS3h-90
EVQLLESGGGLVQPGGSLRLSCAASGFTFDNENMTWVRQAPGKDLEWVSRITERGDVTYYADSVKGRFTISRDNSKNTL
YLQMNSLRAEDTAVYYCAKGRIPTLVFDYWGQGTLVTVSS (SEQ ID NO: 98)

BMS3h-91
EVQLLESGGGLVQPGGSLRLSCAASGFTFSDDSMSWVRQAPGKGLEWVSRINDAGSSTYYADSVKGRFTISRDNSKNTL
YLQMNSLRAEDTAVYYCAKGITPNLTFDYWGQGTLVTVSS (SEQ ID NO: 99)

BMS3h-92
EVQLLESGGGLVQPGGSLRLSCAASGFTFADEPMTWVRQAPGKGLEWVSRIPPEGAPTYYADSVKGRFTISRDNSKNTL
YLQMNSLRAEDTAVYYCAKGLIPDLQFDYWGQGTLVTVSS (SEQ ID NO: 100)

BMS3h-93
EVQLLESGGGLVQPGGSLRLSCAASGFTFQDSDMTWVRQAPGKGLEWVSAIAAPGGSTYYADSVKGRFTISRDNSKNTL
YLQMNSLRAEDTAVYYCAKDRIPNLRFDYWGQGTLVTVSS (SEQ ID NO: 101)

BMS3h-94
EVQLLESGGGLVQPGGSLRLSCAASGFTFVSDTMSWVRQAPGKGLEWVSRIDGTGGDTYYADSVKGRFTISRDNSKNTL
YLQMNSLRAEDTAVYYCAKGQVPELLFDYWGQGTLVTVSS (SEQ ID NO: 102)

BMS3h-95
EVQLLESGGGLVQPGGSLRLSCAASGFTFQDSDMTWVRQAPGKGLEWVSAIAAPGGSTYYADSVKGRFTISRDNSKNTL
YLQMNSLRAEDTAVYYCAKDRIPNLVFDYWGQGTLVTVSS (SEQ ID NO: 103)

BMS3h-96
EVQLLESGGGLVQPGGSLRLSCAAAGFTFDLAEMTWVRQAPGKGLEWVSRIDEDGASTYYADSVKGRFTISRDNSKNTL
YLQMNSLRAEDAAVYYCAEGVIPSLTFDYWGQGTLVTVSS (SEQ ID NO: 104)

BMS3h-97
EVQLLESGGGLVQPGGSLRLSCAASGFTFTDKHMSWVRQAPGKGLEWVSRISPDGTYTYYADSVKGRFTISRDNSKNTL
YLQMNSLRAEDAAVYYCAEGVIPSLTFDYWGQGTLVTVSS (SEQ ID NO: 105)

BMS3h-98
EVQLLESGGGLVQPGGSLRLSCAASGFTFAEDDMTWVRQAPGKGLEWVSRIAVDGDRTYYADSVKGRFTISRDNSKNTL
YLQMNSLRTEDTAVYYCAKGKTPHLVFDYWGQGTLVTVSS (SEQ ID NO: 106)

BMS3h-99
EVQLLESGGGLVQPGGSLRLSCAAAGFTFDLAEMTWVRQAPGKGLEWVSRIDEDGASTYYADSVKGRFTISRDNSKNTL
YLQMNSLRAEDTAVYYCAKGQVPALVFDYWGQGTLVTVSS (SEQ ID NO: 107)

BMS3h-100
EVQLLESGGGLVQPGGSLRLSCAASGFTFEDSMMSWVRQAPGKGLEWVSRIDPGGAQTYYADSVKGRFTISRDNSKNTL
YLQMNSLRAEDTAVYYCAKGVTPDLTFDYWGQGTLVTVSS (SEQ ID NO: 108)

BMS3h-101
EVQLLESGGGLVQPGGSLRLSCAASGFTFEHADMSWVRQASGKGLEWVSRIDNSGQSTYYADSVKGRFTISRDNSKNTL
YLQMNSLRAEDTAVYYCAKGVTPDLTFDYWGQGTLVTVSS (SEQ ID NO: 109)

BMS3h-102
EVQLLESGGGLVQPGGSLRLSCAASGFTFSEAEMNWVRQAPGKGLEWVSRITTDGDSTYYADSVKGRFTISRDNSKNTL
YLQMNSLRAEDTAVYYCAKGRIPTLHFDYWGQGTLVTVSS (SEQ ID NO: 110)

BMS3h-103
EVQLLESGGGLVQPGGSLRLSCAASGFTFDDSDMTWVRQAPGKSLEWVSYIRGDDDETYYADSVKGRFTISRDNSKNTL
YLQMNSLRAEDTAVYYCAKNRIPDLVFDYWGQGTLVTVSS (SEQ ID NO: 111)

BMS3h-108
EVQLLESGGGLVQPGGSLRLSCAASGFTFNVADMQWVRQAPGKGLEWVSSISPNGWDTYYADSVKGRFTISRDNSKNTL
YLQMNSLRAEDTAVYYCAKHASTEGPTAFDYWGQGTLVTVSS (SEQ ID NO: 112)

BMS3h-109
EVQLLESGGGLVQPGGSLRLSCAASGFTFGPYDMGWVRQAPGKGLEWVSWISAHGSFTYYADSVKGRFTISRDNSKNTL
YLQMNSLRAEDTAVYYCAKWPYKFDYWGQGTLVTVSS (SEQ ID NO: 113)

BMS3h-110
EVQLLESGGGLVQPGGSLRLSCAASGFTFGSGSMSWVRQAPGKGLEWVSRIGSNGADTYYADSVKGRFTISRDNSKNTL
YLQMNSLRAEDTAVYYCAKGMVPNLVFDYWGQGTLVTVSS (SEQ ID NO: 114)

BMS3h-111
EVQLLESGGGLVQPGGSLRLSCAASGFTFNRFDMTWVRQAPGKGLEWVSAISGSGGSTYYADSVKGRFTISRDNSKNTL
YLQMNSLRAEDTAVYYCAKDRIPNLVFDYWGQGTLVTVSS (SEQ ID NO: 115)

BMS3h-112
EVQLLESGGGLVQPGGSLRLSCAASGFTFGESDMKWVRQAPGKGLEWVSSISPNGWDTYYADSVKGRFTISRDNSKNTL
YLQMNSLRAEDTAVYYCAKSPSSRLKFDYWGQGTLVTVSS (SEQ ID NO: 116)

TABLE 3-continued

Anti-Human CD40 Variable Domain Amino Acid Sequences

BMS3h-139
EVQLLESGGGLVQPGGSLRLSCAASGFTFDSSEMSWVRQAPGKGLEWVSSIENQGGATYYADSVKGRFTISRDNSKNTL
YLQMNSLRAEDTAVYYCAKDRIPNLVFDYWGQGTLVTVSS (SEQ ID NO: 117)

BMS3h-140
EVQLLESGGGLVQPGGSLRLSCAASGFTLDAYPMYWVRQAPGKGLEWVSWIASGGGATYYADSVKGRFTISRDNSKNTL
YLQMNSLRAEDTAVYYCAKRTKNFDYWGQGTLVTVSS (SEQ ID NO: 118)

BMS3h-141
EVQLLESGGGLVQPGGSLRLSCAASGFTFMSYSMAWVRQAPGKGLEWVSGITSNGNRTYYADSVKGRFTISRDNSKNTL
YLQMNSLRAEDTAVYYCAKSTGANSRNFDYWGQGTLVTVSS (SEQ ID NO: 119)

BMS3h-142
EVQLLESGGGLVQPGGSLRLSCAASGFTFEGYLMSWVRQAPGKGLEWVSSIAANGMQTYYADSVKGRFTISRDNSKNTL
YLQMNSLRAEDTAVYYCAKKPRGIWDGDFDYWGQGTLVTVSS (SEQ ID NO: 120)

BMS3h-143
EVQLLESGGGLVQPGGSLRLSCAASGFTFHESTMTWVRQAPGKGLEWVSTIRHPGEFTYYADSVKGRFTISRDNSKNTL
YLQMNSLRAGDTAVYYCAKGLIPDLQFDYWGQGTLVTVSS (SEQ ID NO: 121)

BMS3h-144
EVQLLESGGGLVQPGGSLRLSCAASGFTFAMYSMSWVRQAPGKGLEWVSSIAPPGGRTYYADSVKGRFTISRDNSKNTL
YLQMNSLRAEDTAVYYCAKQSLTGYSRSFDYWGQGTLVTVSS (SEQ ID NO: 122)

BMS3h-145
EVQLLESGGGLVQPGGSLRLSCAASGFTFSQNPMSWVRHAPGKGLEWVSTIPANGRPTSYADSVKGRFTISRDNSKNTL
YLQMNSLRAEDTAVYYCAKYSQQPGRRFDYWGQGTLVTVSS (SEQ ID NO: 123)

BMS3h-146
EVQLLESGGGLVQPGGSLRLSCAASGFTFANYHMTWVRQAPGKGLEWVSSIPDSGKQTYYADSVKGRFTISRDNSKNTL
YLQMNSLRAEDTAVYYCAKGRIPSLLFDYWGQGTLVTVSS (SEQ ID NO: 124)

BMS3h-147
EVQLLESGGGLVQPGGSLRLSCAASGFTFAQYHMRWVRQAPGKGLEWVSTINDIGSNTYYADSVKGRFTISRDNSKNTL
YLQMNSLRAEDTAVYYCAKVGGRGSFSFDYWGQGTLVTVSS (SEQ ID NO: 125)

BMS3h-148
EVQLLESGGGLVQPGGSLRLSCAASGFTFSSYDMKWVRQAPGKGLEWVSTISASGVFTYYADSVKGRFTISRDNSKNTL
YLQMNSLRAEDTAVYYCAKREHAGQPPFDYWGQGTLVTVSS (SEQ ID NO: 126)

BMS3h-149
EVQLLESGGGLVQPGGSLRLSCAASGFTFNGYAMSWVRQAPGKGLEWVSTINANGKYTYYADSVKGRFTISRDNSKNTL
YLQMNSLRAEDTAVYYCAKKLTLASNYFDYWGQGTLVTVSS (SEQ ID NO: 127)

BMS3h-150
EVQLLESGGGLVQPGGSLRLSCAASGFTFMDYDMKWVRQAPGKGLEWVSSITALGKKTYYADSVKGRFTISRDNSKNTL
YLQMNSLRAEDTAVYYCAKDSVKYPLNLFDYWGQGTLVTVSS (SEQ ID NO: 128)

BMS3h-151
EVQLLESGGGLVQPGGSLRLSCAASGFTFPHYTMAWVRQAPGKGLEWVSSIQSPGWRTYYADSVKGRFTISRDNSKNTL
YLQMNSLRAEDTAVYYCAKYGDGLPLTFDYWGQGTLVTVSS (SEQ ID NO: 129)

BMS3h-167
EVQLLESGGGLVQPGGSLRLSCAASGFTFSGTPMSWVRQAPGKGLEWVSRIGDEGQETYYADSVKGRFTISRDNSKNTL
YLQMNSLRAEDTAVYYCAKGVTPDLTFDYWGQGTLVTVSS (SEQ ID NO: 130)

BMS3h-168
EVQLLESGGGLVQPGGSLRLSCAASGFTFSSSSMSWVRQAPGKGLEWVSAIGSDGPSTYYADSVKGRFTISRDNSKNTL
YLQMNSLRAEDTAVYYCAKGRIPTLHFDYWGQGTLVTVSS (SEQ ID NO: 131)

BMS3h-169
EVQLLESGGGLVQPGGSLRLSCAASGFTFNPGEMTWVRQAPGKGLEWVSSIDGSGSSTYYADSVKGRFTISRDNSKNTL
YLQMNSLRADDTAVYYCAKGRIPTLHFDYWGQGTLVTVSS (SEQ ID NO: 132)

BMS3h-170
EVQLLESGGGLVQPGGSLRLSCAASGFTFPESMMGWVRQAPGKGLEWVSSIGYPGATTYYADSVKGRFTISRDNSKNTL
YLQMNSLRAEDTAVYYCAKGGSRDDNFDYWGQGTLVTVSS (SEQ ID NO: 133)

BMS3h-171
EVQLLESGGGLVQPGGSLRLSCAASGFTFGQHSMHWVRQAPGKGLEWVSSISVPGPKTYYADSVKGRFTISRDNSKNTL
YLQMNSLRAEDTAVYYCAKSLRDLRPGDSKSFDYWGQGTLVTVSS (SEQ ID NO: 134)

BMS3h-197
EVQLLESGGGLVQPGGSLRLSCAASGFTFGSAAMDWVRQAPGKGLEWVSSINDMGSNTYYADSVKGRFTISRDNSKNTL
YLQMNSLRAEDTAVYYCAKQGGRFDYWGQGTLVTVSS (SEQ ID NO: 135)

TABLE 3-continued

Anti-Human CD40 Variable Domain Amino Acid Sequences

BMS3h-199
EVQLLESGGGLVQPGGSLRLSCAASGFTFGYDRMAWVRQAPGKGLEWVSSIDGPGGATYYADSVKGRFTISRDNSKNTL
YLQMNSLRAEDTAVYYCAEGRRVPDFDYWGQGTLVTVSS (SEQ ID NO: 136)

BMS3h-200
EVQLLESGGGLVQPGGSLRLSCAASGFTFGEYEMTWVRQAPGKGLEWVSRIDPFGSETYYADSVKGRFTISRDNSKNTL
YLQMNSLRAEDTAVYYCAEGVVPDLNFDYWGQGTLVTVSS (SEQ ID NO: 137)

BMS3h-201
EVQLLESGGGLVQPGGSLRLSCAASGFTFDKYVMGWVRQAPGKGLEWVSTIGSYGGATYYADSVKGRFTISRDNSKNTL
YLQMNSLRAEDTAVYYCAKRLTLSATKFDYWGQGTLVTVSS (SEQ ID NO: 138)

BMS3h-203
EVQLLESGGGLVQPGGSLRLSCAASGFTFEDYVMGWVRQAPGKGLEWVSTIAHRGDITYYADSVKGRFTISRDNSKNTL
YLQMNSLRAEDTAVYYCAKRRRLSDYRFDYWGQGTLVTVSS (SEQ ID NO: 139)

BMS3h-204
EVQLLESGGGLVQPGGSLRLSCAASGFTFGQFDMYWVRQAPGKGLEWVSAISPAGTGTYYADSVKGRFTISRDNSKNTL
YLQMNSLRAEDTAVYYCAKAGDRSSLFDYRGQGTLVTVSS (SEQ ID NO: 140)

BMS3h-205
EVQLLESGGGLVQPGGSLRLSCAASGFTFKDTGMTWVRQAPGKGLEWVSSISSYGRDTYYADSVKGRFTISRDNSKNTL
YLQMNSLRAEDAAVYYCAKLNAALGFDYWGQGTLVTVSS (SEQ ID NO: 141)

BMS3h-206
EVQLLESGGGLVQPGGSLRLSCAASGFTFGPYPMSWVRQAPGKGLEWVSGINAPGTRTYYADSVKGRFTISRDNSKNTL
YLQMNSLRAEDTAVYYCAQQMSSGVFDYWGQGTLVTVSS (SEQ ID NO: 142)

BMS3h-207
EVQLLESGGGLVQPGGSLRLSCAASGFTFSNQDMTWVRQAPGKGLEWVSSIDSSGQLTYYADSVKGRFTISRDNSKNTL
YLQMNSLRAEDTAVYYCAKVKSLARFDYWGQGTLVTVSS (SEQ ID NO: 143)

BMS3h-208
EVQLLESGGGLVQPGGSLRLSCAASGFTFPESDMKWVRQAPGKGLEWVSSISPNGWDTYYADSVKGRFTISRDNSKNTL
YLQMNSLRAEDTAVYYCAKPAQVLFDYWGQGTLVTVSS (SEQ ID NO: 144)

BMS3h-209
EVQLLESGGGLVQPGGSLRLSCAASGFTFEQYVMGWVRQAPGKGLEWVSTIGTSGKYTYYADSVKGRFTISRDNSKNTL
YLQMNSLRAEDTAVYYCAQRRSLTRVHFDYWGQGTLVTVSS (SEQ ID NO: 145)

BMS3h-210
EVQLLESGGGLVQPGGSLRLSCAASGFTFGVEHMSWVRQAPGKGLEWVSAITGDGDRTYYADSVKGRFTISRDNSKNTL
YLQMNSLRAEDTAVYYCAKTVSWNGRFDYWGQGTLVTVSS (SEQ ID NO: 146)

BMS3h-211
EVQLLESGGGLVQPGGSLRLSCAASGFTFAWYNMGWVRQAPGKGLEWVSRIAPSGIITYYADSVKGRFTISRDNSKNTL
YLQMNSLRAEDTAVYYCAKGLRGKFDYWGQGTLVTVSS (SEQ ID NO: 147)

BMS3h-212
EVQLLESGGGLVQPGGSLRLSCAASGFTFSNYEMRWVRQAPGKGLEWVSSISSAGTDTYYADSVKGRFTISRDNSKNTL
YLQMNSLRAEDTAVYYCAKQSLNFDYWGQGTLVTVSS (SEQ ID NO: 148)

BMS3h-213
EVQLLESGGGLVQPGGSLRLSCVASGFTFDEEPMTWVRQAPGKGLEWVSIIDPGGGATYYADSVKGRFTISRDNSKNTL
YLQMNSLRAEDTAVYYCAKSNSMFDYWGQGTLVTVSS (SEQ ID NO: 149)

BMS3h-214
EVQLLESGGGLVQPGGSLRLSCAASGFTFSAYPMHWVRQAPGKGLEWVSSIASSGITTYYADSVKGRFTISRDNSKNTL
YLQMNSLRAEDTAVYYCAKFTRLHFPAQFDYWGQGTLVTVSS (SEQ ID NO: 150)

BMS3h-215
EVQLLESGGGLVQPGGSLRLSCAASGFTFADYAMGWVRQAPGKGLEWVSRISPEGSRTYYADSVKGRFTISRDNSKNTL
YLQMNSLRAEDTAVYYCAKLRPYASKFDYWGQGTLVTVSS (SEQ ID NO: 151)

BMS3h-230
EVQLLESGGGLVQPGGSLRLSCAASGFTFRPYDMGWVRQAPGKGLEWVSTISHQGNRTYYADSVKGRFTISRDNSKNTL
YLQMNSLRAEDTAVYYCAKVSHHFDYWGQGTLVTVSS (SEQ ID NO: 152)

BMS3h-231
EVQLLESGGGLVQPGGSLRLSCAASGFTFSAYNMWWARQAPGKGLEWVSWINSTGSRTYYADSVKGRFTISRDNSKNTL
YLQMNSLRAEDTAVYYCAKNWHRGRFDYWGQGTLVTVSS (SEQ ID NO: 153)

BMS3h-232
EVQLLESGGGLVQPGGSLRLSCAASGFTFDRYRMGWVRQAPGKGLEWVSTINRLGQSTYYADSVKGRFTISRDNSKNTL
YLQMNSLRAEDTAVYYCAKVKKHKFDYWGQGTLVTVSS (SEQ ID NO: 154)

TABLE 3-continued

Anti-Human CD40 Variable Domain Amino Acid Sequences

BMS3h-233
EVQLLESGGGLVQPGGSLRLSCAASGFTFAHYNMRWVRQAPGKGLEWVSTITKTGFRTYYADSVKGRFTISRDNSKNTL
YLQMNSLRAEDTAVYYCAKAGQFDFDYWGQGTLVTVSS (SEQ ID NO: 155)

BMS3h-234
EVQLLESGGGLVQPGGSLRLSCAASGFTFYPYSMHWVRQAPGKGLEWVSTIDGSGMFTYYADSVKGRFTISRDNSKNTL
YLQMNSLRAEDTAVYYCAEDSLKASFDYWGQGTLVTVSS (SEQ ID NO: 156)

BMS3h-235
EVQLLESGGGLVQPGGSLRLSCAASGFTFPLYGMWWVRQAPGKGLEWVSYIGPYGHTTYYADSVKGRFTISRDNSKNTL
YLQMNSLRAEDTAVYYCAKKRKKKFDYWGQGTLVTVSS (SEQ ID NO: 157)

BMS3h-236
EVQLLESGGGLVQPGGSLRLSCAASGFTFPRYRMSWVRQAPGKGLEWVSSITPYGAHTYYADSVKGRFTISRDNSKNTL
YLQMNSLRAEDTAVYYCAKYGKWYFDYWGQGTLVTVSS (SEQ ID NO: 158)

BMS3h-237
EVQLLESGGGLVQPGGSLRLSCAASGFTFNEYAMRWVRQAPGKGLEWVSTIDRLGLHTYYADSVKGRFTISRDNSKNTL
YLQMNSLRAEDTAVYYCAKSGPFTFDYWGQGTLVTVSS (SEQ ID NO: 159)

BMS3h-238
EVQLLESGGGLVQPGGSLRLSCAASGFTFERYNMRWVRQAPGKGLEWVSTIDRLGLATYYADSVKGRFTISRDNSKNTL
YLQMNSLRAEDTAVYYCAKAGSWSFDYWGQGTLVTVSS (SEQ ID NO: 160)

BMS3h-239
EVQLLESGGGLVQPGGSLRLSCAASGFTFGIYDMKWVRQAPGKGLEWVSTISSSGTHTYYADSVKGRFTISRDNSKNTL
YLQMNSLRAEDTAVYYCAKYPQPYPFDYWGQGTLVTVSS (SEQ ID NO: 161)

BMS3h-240
EVQLLESGGGLVQPGGSLRLSCAASGFTFWWDMRWRQAPGKGLEWVSTISATGVHTYYADSVKGRFTISRDNSKNTL
YLQMNSLRAEDTAVYYCAKYPPAGRFDYWGQGTLVTVSS (SEQ ID NO: 162)

BMS3h-241
EVQLLESGGGLVQPGGSLRLSCAASGFTFSTYDMIWVRQAPGKGLEWVSAISPNGTGTYYADSVKGRFTISRDNSKNTL
YLQMNSLRAEDTAVYYCAKPPQVNTEFDYRGQGTLVTVSS (SEQ ID NO: 163)

BMS3h-243
EVQLLESGGGLVQPGGSLRLSCAASGFTFEKEDMGWVRQAPGKGLEWVSHISPNGYATYYADSVKGRFTISRDNSKNTL
YLQMNSLRAEDTAVYYCAKSWSSFDYWGQGTLVTVSS (SEQ ID NO: 164)

BMS3h-244
EVQLLESGGGLVQPGGSLRLSCAASGFTFSATPMEWARQAPGKGLEWVSTISESGYSTYYADSVKGRFTISRDNSKNTL
YLQMNSLRAEDTAVYYCAKWNSTTGFDYWGQGTLVTVSS (SEQ ID NO: 165)

BMS3h-245
EVQLLESGGGLVQPGGSLRLSCAASGFTFNTVDMEWVRQAPGKGLEWVSSISPNGWDTYYADSVKGRFTISRDNSKNTL
YLQMNSLRAEDTAVYYCAEAPHRAFDYWGQGTLVTVSS (SEQ ID NO: 166)

BMS3h-246
EVQLLESGGGLVQPGGSLRLSCAASGFTFEDKEMSWVRQAPGKGLEWVSRIDALGDSTYYADSVKGRFTISRDNSKNTL
YLQMNSLRAEDTAVYYCAEGMVPRLKFDYWGQGTLVTVSS (SEQ ID NO: 167)

BMS3h-247
EVQLLESGGGLVQPGGSLRLSCAASGFTFSDHSMMWVRQAPGKGLEWVSDIEPHGVHTYYADSVKGRFTISRDNSKNTL
YLQMNSLRAEDTAVYYCANPTFDYWGQGTLVTVSS (SEQ ID NO: 168)

BMS3h-248
EVQLLESGGGLVQPGGSLRLSCAASGFTFSPHTMHWVRQAPGKGLEWVSGIGPDGTTTYYADSVKGRFTISRDNSKNTL
YLQMNSLRAEDTAVYYCAKRSYSWDRGWTFDYWGQGTLVTVSS (SEQ ID NO: 169)

BMS3h-249
EVQLLESGGGLVQPGGSLRLSCAASGFTFYASDMKWVRQAPGKGLEWVSSISPNGWDTYYADSVKGRFTISRDNSKNTL
YLQMNSLRAEDTAVYYCAKADYTYHSFDYWGQGTLVTVSS (SEQ ID NO: 170)

BMS3h-250
EVQLLESGGGLVQPGGSLRLSCAASGFTFAHYNMRWVRQAPGKGLEWVSTITKTGFRTYYADSVKGRFTISRDNSKNTL
YLQMNSLRAEDTAVYYCAKAGQFDFDYWGQGTLVTVSS (SEQ ID NO: 171)

BMS3h-251
EVQLLESGGGLVQPGGSLRLSCAASGFTFSHYHMGWARQAPGKGLEWVSVIGPRGISTYYADSVKGRFTISRDNSKNTL
YLQMNSLRAEDTAVYYCAKSPSRHRFDYWGQGTLVTVSS (SEQ ID NO: 172)

BMS3h-252
EVQLLESGGGLVQPGGSLRLSCAASGFTFNEYAMRWVRQAPGKGLEWVSTIDRLGLHTWADSVKGRFTISRDNSKNTL
YLQMNSLRAEDTAVYYCAKSGPFTFDYWGQGTLVTVSS (SEQ ID NO: 173)

TABLE 3-continued

Anti-Human CD40 Variable Domain Amino Acid Sequences

BMS3h-253
EVQLLESGGGLVQPGGSLRLSCAASGFTFGNYSMKWARQAPGKGLEWVSTITPDGWYTYYADSVKGRFTISRDNSKNTL
YLQMNSLRAEDTAVYYCAKVGDAVWGWIGGFDYWGQGTLVTVSS (SEQ ID NO: 174)

BMS3h-254
EVQLLESGGGLVQPGGSLRLSCAASGFTFGDYGMKWVRQAPGKGLEWVSAITSNGDFTYYADSVKGRFTISRDNSKNTL
YLQMNSLRAEDTAVYYCAKSLYKFDYWGQGTLVTVSS (SEQ ID NO: 175)

BMS3h-255
EVQLLESGGGLVQPGGSLRLSCAGSGFTFPTYKMGWVRQAPGKGLEWVSFIDYWGWRTYYADSVKGRFTISRDNSKNTL
YLQMNSLRAEDTAVYYCAKSPYSWTHDSPHFDYWGQGTLVTVSS (SEQ ID NO: 176)

BMS3h-256
EVQLLESGGGLVQPGGSLRLSCAASGFTFRPYTMCWARQAPGKGLEWVSCISDAGSFTYYADSVKGRFTISRDNSKNTL
YLQMNSLRAEDTAVYYCAKRMSSFDYWGQGTLVTVSS (SEQ ID NO: 177)

BMS3h-257
EVQLLESGGGLVQPGGSLRLSCAASGFTFQNYQMAWVRQAPGKGLEWVSTISGTGKNTYYADSVKGRFTISRDNSKNTL
YLQMNSLRAEDTAVYYCAKTPQNYFSVRRFDYWGQGTLVTVSS (SEQ ID NO: 178)

BMS3h-258
EVQLLESGGGLVQPGGSLRLSCAASGFTFGAYTMGWVRQAPGKGLEWVSKISTSGGQTYYADSVKGRFTISRDNSKNTL
YLQMNSLRAEDTAVYYCAKPLNWWAFDYWGQGTLVTVSS (SEQ ID NO: 179)

BMS3h-272
EVQLLESGGGLVQPGGSLRLSCAASGFTFNAYPMTWVRQAPGKGLEWVSRIDGYGRHTYYADSVKGRFTISRDNSKNTL
YLQMNSLRAEDTAVYYCAKGIIPNFDYWGQGTLVTVSS (SEQ ID NO: 180)

BMS3h-273
EVQLLESGGGLVQPGGSLRLSCAASGFTFGAVDMTWVRQAPGKGLEWVSAISPSGSATYYADSVKGRFTISRDNSKNTL
YLQMNSLRAEDTAVYYCAKGRVPDLGFDYWGQGTLVTVSS (SEQ ID NO: 181)

BMS3h-274
EVQLLESGGGLVQPGGSLRLSCAASGFTFDSYAMGWARQAPGKGLEWVSAIGAKGLSTYYADSVKGRFTISRDNSKNTL
YLQMNSLRAEDTAVYYCAKAARGKFDYWGQGTLVTVSS (SEQ ID NO: 182)

BMS3h-275
EVQLLESGGGLVQPGGSLRLSCAASGFTFTRYQMGWVRQAPGKGLEWVSVINVWGSSTYYADSVKGRFTISRDNSKNTL
YLQMNSLRAEDTAVYYCAKMSGKFAYWGQGTLVTVSS (SEQ ID NO: 183)

BMS3h-276
EVQLLESGGGLVQPGGSLRLSCAASGFTFGNYSMMWVRQAPGKGLEWVSTIIPAGTSTYYADSVKGRFTISRDNSKNTL
YLQMNSLRAEDTAVYYCAKPSIRLFDYWGQGTLVTVSS (SEQ ID NO: 184)

BMS3h-279
EVQLLESGGGLVQPGGSLRLSCAASGFTFGAYDMGWVRQAPGKGLEWVSWISPNGYDTYYADSVKGRFTISRDNSKNTL
YLQMNSLRAEDTAVYYCAKGGVKFDYWGQGTLVTVSS (SEQ ID NO: 185)

BMS3h-282
EVQLLESGGGLVQPGGSLRLSCAASGFTFVWYEMAWVRQAPGKGLEWVSTIQADGEQTYYADSVKGRFTISRDNSKNTL
YLQMNSLRAEDTAVYYCAKASYALVYPPEEFDYWGQGTLVTVSS (SEQ ID NO: 186)

BMS3h-287
EVQLLESGGGLVQPGGSLRLSCAASGFTFTNYRMSWVRQAPGKGLEWVSAIDDLGVSTYYADSVKGRFTISRDNSKNTL
YLQMNSLRAEDTAVYYCAKWRLKNSQPTDFDYWGQGTLVTVSS (SEQ ID NO: 187)

BMS3h-292
EVQLLESGGGLVQPGGSLRLSCAASGFTFDQAHMWWVRQAPGKGLEWVSFINPSGYYTYYADSVKGRFTISRDNSKNTL
YLQMNSLRAEDTAVYYCAKPSLSPSSFDYWGQGTLVTVSS (SEQ ID NO: 188)

BMS3h-293
EVQLLESGGGLVQPGGSLRLSCAASGFTFETGQMGWARQAPGKGLEWVSNIDGSGTYTYYADSVKGRFTISRDNSKNTL
YLQMNSLRAEDTAVYYCAKSTQNYRFDYWGQGTLVTVSS (SEQ ID NO: 189)

BMS3h-296
EVQLLESGGGLVQPGGSLRLSCAASGFTFGAYPMYWVRQAPGKGLEWVSSIHKDGRITYYADSVKGRFTISRDNSKNTL
YLQMNSLRAEDTAVYYCAKQGTPVDGFDYWGQGTLVTVSS (SEQ ID NO: 190)

BMS3h-297
EVQLLESGGGLVQPGGSLRLSCAASGFTFPDEGMTWVRQAPGKGLEWVSTIETGGTVTYYADSVKGRFTISRDNSKNTL
YLQMNSLRAEDTAVYYCAKMDGSGTWQTFDYWGQGTLVTVSS (SEQ ID NO: 191)

BMS3h-298
EVQLLESGGGLVQPGGSLRLSCAASGFTFDSLGMGWARQAPGKGLEWVSYIRAEGAYTYYADSVKGRFTISRDNSKNTL
YLQMNSLRAEDTAVYYCAKYLADSDYWGQGTLVTVSS (SEQ ID NO: 192)

TABLE 3-continued

Anti-Human CD40 Variable Domain Amino Acid Sequences

BMS3h-299
EVQLLESGGGLVQPGGSLRLSCAASGFTFSESYMEWVRQAPGKGLEWVSGIDHIGGGTYYADSVKGRFTISRDNSKNTL
YLQMNSLRAEDTAVYYCAKDDGRGGSMFDYWGQGTLVTVSS (SEQ ID NO: 193)

BMS3h-300
EVQLLESGGGLVQPGGSLRLSCAASGFTFSGGYMWWVRQAPGKGLEWVSSIGASGAYTYYADSVKGRFTISRDNSKNTL
YLQMNSLRAEDTAVYYCAKTGGRLDYWGQGTLVTVSS (SEQ ID NO: 194)

BMS3h-301
EVQLLESGGGLVQPGGSLRLSCAASGFTFDEGHMGWVRQAPGKDLEWVSYIGSLGLHTYYADSVKGRFTISRDNSKNTL
YLQMNSLRAEDTAVYYCAKREFSNGGFDYWGQGTLVTVSS (SEQ ID NO: 195)

BMS3h-302
EVQLLESGGGLVQPGGSLRLSCAASGFTFKTSPMYWVRQAPGKGLEWVSSIDRTGGHTYYADSVKGRFTISRDNSKNTL
YLQMNSLRAEDTAVYYCAKQALLTDAKRFDYWGQGTLVTVSS (SEQ ID NO: 196)

BMS3h-303
EVQLLESGGGLVQPGGSLRLSCAASGFTFDGRDMVWVRQAPGKGLEWVSAISPSGLDTYYADSVKGRFTISRDNSKNTL
YLQMNSLRAEDTAVYYCAERPQMLVTNFDYWGQGTLVTVSS (SEQ ID NO: 197)

BMS3h-304
EVQLLESGGGLVQPGGSLRLSCAASGFTFGNDPMSWVRQAPGKGLEWVSGIGREGDSTYYADSVKGRFTISRDNSKNTL
YLQMNSLRAEDTAVYYCAKDSMRHQPFDYWGQGTLVTVSS (SEQ ID NO: 198)

BMS3h-305
EVQLLESGGGLVQPGGSLRLSCAASGFTFDETYMKWVRQAPGKGLEWVSAIGASGADTYYADSVKGRFTISRDNSKNTL
YLQMNSLRAEDTAVYYCAKFTHLNGRFDYWGQGTLVTVSS (SEQ ID NO: 199)

BMS3h-306
EVQLLESGGGLVQPGGSLRLSCAASGFTFGGWPMGWVRQAPGKGLEWVSGIDIDGAPTYYADSVKGRFTISRDNSKNTL
YLQMNSLRAEDTAVYYCAKEEAGSWSFDYWGQGTLVTVSS (SEQ ID NO: 200)

BMS3h-307
EVQLLESGGGLVQPGGSLRLSCAASGFTFSDQAMWWARQAPGKGLEWVSFIQGDGGFTYYADSVKGRFTISRDNSKNTL
YLQMNSLRAEDTAVYYCAKPSKPFDYWGQGTLVTVSS (SEQ ID NO: 201)

BMS3h-308
EVQLLESGGGLVQPGGSLRLSCAASGFTFETGQMGWARQAPGKGLEWVSNIDGSGTYTYYADSVKGRFTISRDNSKNTL
YLQMNSLRAEDTAVYYCAKAVRNFAFDYWGQGTLVTVSS (SEQ ID NO: 202)

BMS3h-309
EVQLLESGGGLVQPGGSLRLSCAASGFTFSGHDMSWVRQAPGKGLEWVSAISPHGTHTYYADSVKGRFTISRDNSKNTL
YLQMNSLRAEDTAVYYCAKGIRGWIGHDTQPFDYWGQGTLVTVSS (SEQ ID NO: 203)

BMS3h-310
EVQLLESGGGLVQPGGSLRLSCAASGFTFESKDMLWVRQAPGKGLEWVSSISSDGTHTYYADSVKGRFTISRDNSKNTL
YLQMNSLRAEDTAVYYCAQELGGSWQFDYWGQGTLVTVSS (SEQ ID NO: 204)

BMS3h-311
EVQLLESGGGLVQPGGSLRLSCAASGFTFADRDMVWVRQAPGKGLEWVSGIGASGTSTYYADSVKGRFTISRDNSKNTL
YLQMNSLRAEDAAVYYCAKGGTGPTDLWDFDYWGQGTLVTVSS (SEQ ID NO: 205)

BMS3h-312
EVQLLESGGGLVQPGGSLRLSCAASGFTFDDEKMLWVRQAPGKGLEWVSSISVSGLHTYYADSVKGRFTISRDNSKNTL
YLQMNSLRAEDTAVYYCAKEEAGSWSFDYWGQGTLVTVSS (SEQ ID NO: 206)

BMS3h-313
EVQLLESGGGLVQPGGSLRLSCAASGFTFGQERMIWVRQAPGKGLEWVSDISASGGTTYYADSVKGRFTISRDNSKNTL
YLQMNSLRAEDTAVYYCAKEEAGSWSFDYWGQGTLVTVSS (SEQ ID NO: 207)

BMS3h-37-1
EVQLLESGGGLVQPGGSLRLSCAASGFTFEWYEMQWVRQAPGKGLEWVSAISGDGYRTYYADSVKGRFTISRDNSMNTL
YLQMNSLRAEDTAVYYCAKELGYFDYRGRGTLVTVSS (SEQ ID NO: 208)

BMS3h-37-2
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELGYFDYWGRGTLVTVSS (SEQ ID NO: 209)

BMS3h-37-3
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELGYFDYRVQGTLVTVSS (SEQ ID NO: 210)

BMS3h-37-4
EVQLLESGGGLVQPGGSLRLSCAASGFTFEWYEMQWVRKAPGKGLEWVSAISGDGYRTYYADSVKGRFTISRDNSKNTL
YLQMNSLRAEDTAVYYCAKELGYFDYWGRGTLVTVSS (SEQ ID NO: 211)

TABLE 3-continued

Anti-Human CD40 Variable Domain Amino Acid Sequences

BMS3h-37-5
EVQLLESGGGLVQPGGSLRLSCAASGFTFEWYEMQWVRQAPGKGLEWISAISGDGYRTYYADSVKGRFTISRDNSKNTL
YLQMNSLRAEDTAVYYCAKELGYFDYRVQGTLVTVSS (SEQ ID NO: 212)

BMS3h-37-6
EVQLLESGGGLVQPGGSLRLSCAASGFTFEWYEMQWVRRAPGKGLEWVSAISGDGYRTYYADSVKGRFTISRDNSENTL
YLQMNSLRAEDTAVYYCAKELGYFDYWGRGTLVTVSS (SEQ ID NO: 213)

BMS3h-37-7
EVQLLETGGGLVQPGGSLRLSCAASGFTFEWYEMQWVRRAPGKGLEWVSAISGDGYRTYYADSVKGRFTISRDNSKNTL
YLQMDSLRAEDTAVYYCAKELGYFDYWGRGTLVTVTS (SEQ ID NO: 214)

BMS3h-37-8
EVQLLESGGGLVQPGGSLRLSCAASGFTFEWYEMQWVRQAPGKGLEWVSAISGDGYRTYYADSVKGRFTISRDNSKNTL
YLQMNSLRAEDTAVYYCAKELGYFHYWGRGTLVTVSS (SEQ ID NO: 215)

BMS3h-37-9
EVQLLESGGGLVQPGGSLRLSCVASGFTFEWYEMQWVRQAPGNGLEWISAISGDGYRTYYADSVKGRFTISRDNSKNTL
YLQMNSLRAEDTAVYYCAKELGYFDYWGRGTLVTVSS (SEQ ID NO: 216)

BMS3h-37-10
EVQLLESGGGLVQPGGSLRLSCAASGFTFEWYEMQWVRRAPGKGLEWVSAISGDGYRTYYADSVKGRFTISRDNSKNTL
YLLMNSLRAEDTAVYYCAKELGYFDYWGRGTLVTVSS (SEQ ID NO: 217)

BMS3h-37-11
EVQLLESGGGLVQPGGSLRLSCAASGFTFEWYEMQWVRKAPGKGLEWVSAISGDGYRTYYADSVKGRFTISRDNSKNTL
YLQMNSLRAEDTAVYYCAKELGYFDYRGRGTLVTVSS (SEQ ID NO: 218)

BMS3h-37-12
EVQLLESGGGLVQPGGSMRLSCAASGFTFEWYEMQWVRRAPGKGLEWVSAISGDGYRTYYADSVKGRFTISRDNSKNTL
YLQMNSLRAEDTAVYYCAKELGYFDYRGRGTLVTVSS (SEQ ID NO: 219)

BMS3h-37-201
EVQLLESGGGLVQPGGSLRLSCAASGFTFEWYEMQWVRRAPGKGLEWVSMISGDGYRTYYADSVKGRFTISRDNSKNTL
YLQMNSLRAEDTAVYYCAKELGYFDYWGRGTLVTVSS (SEQ ID NO: 220)

BMS3h-37-202
EVQLLESGGGLVQPGGSLRLSCAASGFTFEWYEMQWVRRAPGKGLEWVSAISGDGWRTYYADSVKGRFTISRDNSKNTL
YLQMNSLRAEDTAVYYCAKELGYFDYWGRGTLVTVSS (SEQ ID NO: 221)

BMS3h-37-203
EVQLLESGGGLVQPGGSLRLSCAASGFTFGWYEMQWVRRAPGKGLEWVSAISGDGYRTYYADSVKGRFTISRDNSKNTL
YLQMNSLRAEDTAVYYCAKELLYFDYWGRGTLVTVSS (SEQ ID NO: 222)

BMS3h-37-204
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELGFFDYWGRGTLVTVSS (SEQ ID NO: 223)

BMS3h-37-205
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELEYFDYWGRGTLVTVSS (SEQ ID NO: 224)

BMS3h-37-206
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKGLEYFDYWGRGTLVTVSS (SEQ ID NO: 225)

BMS3h-37-207
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELAFFDYWGRGTLVTVSS (SEQ ID NO: 226)

BMS3h-37-208
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELLYFDYWGRGTLVTVSS (SEQ ID NO: 227)

BMS3h-37-209
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELEFFDYWGRGTLVTVSS (SEQ ID NO: 228)

BMS3h-37-210
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELQFFDYWGRGTLVTVSS (SEQ ID NO: 229)

BMS3h-37-211
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELLFFDYWGRGTLVTVSS (SEQ ID NO: 230)

TABLE 3-continued

Anti-Human CD40 Variable Domain Amino Acid Sequences

BMS3h-37-212
EVQLLESGGGLVRPGGSLRLSCAASGFTFEWYEMQWVRRAPGKGLEWVSAISGDGYRTYYADSVKGRFTISRDNSKNTL
YLQMNSLRAEDTAVYYCAKELEFFDYWGRGTLVTVSS (SEQ ID NO: 231)

BMS3h-37-213
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELLFFDYRGRGTLVTVSS (SEQ ID NO: 232)

BMS3h-37-214
EVQLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKNLEYFDYWGRGTLVTVSS (SEQ ID NO: 233)

BMS3h-37-215
EVRLLESGGGLVQPGGSLRLSCAASGFTFEWYEMQWVRRAPGKGLEWVSAISGDGYRTYYADSVKGRFTISRDNSKNTL
YLQMNSLRAEDTAVYYCAKELQFFDYWGRGTLVTVSS (SEQ ID NO: 234)

BMS3h-38-1
EVQLLGSGGGLVQPGGSLRLSCAASGFTFEEEEMIWVRQAPGKGLEWVSAISGSGGSTYYADSVKGRFTISRDNSKNTL
YLQMNSLRAEDTAVYYCSKEPFRFDYWGQGTLVTVSS (SEQ ID NO: 235)

BMS3h-38-2
EVQLLASGGGLVQPGGSLRLSCAASGFTFEEEEMIWVRQAPGKGLEWVSAISGSGGSTYYADSVKGRFTISRDNSKNTL
YLQMNSLRAEDTAVYYCGKEPFRYDYWGQGTLVTVSS (SEQ ID NO: 236)

BMS3h-38-3
EVQLLASGGGLVQPGGSLRLSCAASGFTFEEEEMIWVRQAPGKGLEWISAISGSGGSTYYADSVKGRFTISRDNSKNTL
YLQMNSLRAEDTAVYYCGKEPFRFDYWGQGTLVTVSS (SEQ ID NO: 237)

BMS3h-38-4
EVQLLDPGGGLVQPGGSLRLSCAASGFTFGKEEMIWVRQAPGKGLEWVSSISGSGGSTYYADSVKGRFTISRDNSRNTL
YLQMNSLRAEDTAVYYCGKEPFRFDYWGQGTLVTVSS (SEQ ID NO: 238)

BMS3h-38-5
EVQLLGSGGGLVQPGGSLRLSCAASGFTEEEEMIWVRQAPGKGLEWVSAISGSGGSTYYADSVKGRFTISRDNSKNTL
YLQMNSLRAEDTAVYYCGKEPFRFDYWGQGTLVTVSS (SEQ ID NO: 239)

BMS3h-38-6
EVQLLEPGGGLVQPGGSLRLSCAASGFTFEEEEMIWVRQAPGKGLEWVSAISGSGGSTYYADSVKGRFTISRDNSKNTL
YLLMNSLRAEDTAVYYCSKEPFRFDYWGQGALVTVSS (SEQ ID NO: 240)

BMS3h-38-7
EVQLLDPGGGLVQPGGSLRLSCAASGFTFGKEEMIWVRQAPGKGLEWVSSISGSGGSTYYADSVKGRFTISRDNSKNTL
YLQMNSLRAEDTAVYYCAKEPLRFDYWGQGTLVTVSS (SEQ ID NO: 241)

BMS3h-38-8
EVQLLESGGGLVQPGGSLRLSCAASGFTFEEEEMIWVRQAPGKGLEWISAISGSGGSTYYADSVKGRFTIHRDNSKNTL
YLQMNSLRAEDTAVYYCSKEPFRFDYRGLGTLVTVSS (SEQ ID NO: 242)

BMS3h-38-9
EVQLLDPGGGLVQPGGSLRLSCAASGFTFGKEEMIWVRQAPGKGLEWVSSISGSGGSTYYADSVKGRFTISRDNSRNTL
YLQMNSLRAEDTAVYYCAKEPLRFDYWGQGTLVTVSS (SEQ ID NO: 243)

BMS3h-38-10
EVQLLDSGGGFVQPGGSLRLSCAASGFTFEEEEMIWVRQAPGKGLEWISAISGSGGSTYYADSVKGRFTISRDNSKNTL
YLQMNSLRAEDTAVYYCAKEPFRFDYWGQGTLVTVSS (SEQ ID NO: 244)

BMS3h-38-11
EVQLLDPGGGLVQPGGSLRLSCAASGFTFEEEEMIWVRQAPGKGLEWISAISGSGGSTYYADSVKGRFTISRDNSNNTL
YLQMNSLRAEDTAVYYCGREPFRFDYWGQGTLVTVSS (SEQ ID NO: 245)

BMS3h-38-12
EVRLLESGEGLVQPGGSLRLSCAASGFTFEEEEMIWVRQAPGKGLEWVSAISGSGGSTYYADSVKGRFTISRDNSKNTL
YLQMNSLRAEDTAVYYCGKEPFRFDYWGQGTLVTVSS (SEQ ID NO: 246)

BMS3h-38-13
EVQQLESGGGLVQPGGSLRLSCAASGFTFEEEEMIWVRQAPGKGLEWVSAISGSGGSTYYADSVKGRFTISRDNSKNTL
YLQMNSLRAEDTAVYYCGKEPFRFDYWGQGTLVTVSS (SEQ ID NO: 247)

BMS3h-38-201
EVQLLASGGGLVQPGGSLRLSCAASGFTFEEEEMIWVRQAPGKGLEWVSAISGSGGSTYYADSVKGRFTISRDNSKNTL
YLQMNSLRAEDTAVYYCGKEPFYDYWGQGTLVTVSS (SEQ ID NO: 248)

BMS3h-38-202
EVQLLASGGGLVQPGGSLRLSCAASGFTFEEEEMIWVRQAPGKGLEWVSAISGSGGSTYYADSVKGRFTISRDNSKNTL
YLQMNSLRAEDTAVYYCGKEPFYFDYWGQGTLVTVSS (SEQ ID NO: 249)

TABLE 3-continued

Anti-Human CD40 Variable Domain Amino Acid Sequences

BMS3h-38-203
EVQLLASGGGLVQPGGSLRLSCAASGFTFEEKEMIWVRQAPGKGLEWVSAISGSGGSTYYADSVKGRFTISRDNSKNTL
YLQMNSLRAEDTAVYYCGKEPFFYDYWGQGTLVTVSS (SEQ ID NO: 250)

BMS3h-38-204
EVQLLASGGGLVQPGGSLRLSCAASGFTFPQEEMIWVRQAPGKGLEWVSAISGSGGSTYYADSVKGRFTISRDNSKNTL
YLQMNSLRAEDTAVYYCGKEPFRYDYWGQGTLVTVSS (SEQ ID NO: 251)

BMS3h-38-205
EVQLLASGGGLVQPGGSLRLSCAASGFTFFAAEMIWVRQAPGKGLEWVSAISGSGGSTYYADSVKGRFTISRDNSKNTL
YLQMNSLRAEDTAVYYCGKEPFRYDYWGQGTLVTVSS (SEQ ID NO: 252)

BMS3h-38-206
EVQLLASGGGLVQPGGSLRLSCAASGFTFEEEEMIWVRQAPGKGLEWVSAISRPGTSTYYADSVKGRFTISRDNSKNTL
YLQMNSLRAEDTAVYYCGKEPFRYDYWGQGTLVTVSS (SEQ ID NO: 253)

BMS3h-38-207
EVQLLASGGGLVQPGGSLRLSCAASGFTFEEEEMIWVRQAPGKGLEWVSAISRMGFSTYYADSVKGRFTISRDNSKNTL
YLQMNSLRAEDTAVYYCGKEPFRYDYWGQGTLVTVSS (SEQ ID NO: 254)

BMS3h-38-208
EVQLLASGGGLVQPGGSLRLSCAASGFTFEEEEMIWVRQAPGKGLEWVSAISRWGHSTYYADSVKGRFTISRDNSKNTL
YLQMNSLRAEDTAVYYCGKEPFRYDYWGQGTLVTVSS (SEQ ID NO: 255)

BMS3h-38-209
EVQLLASGGGLVQPGGSLRLSCAASGFTFEEEEMIWVRQAPGKGLEWVSAISRLGWSTYYADSVKGRFTISRDNSKNTL
YLQMNSLRAEDTAVYYCGKEPFRYDYWGQGTLVTVSS (SEQ ID NO: 256)

BMS3h-38-210
EVQLLASGGGLVQPGGSLRLSCAASGFTFEEEEMIWVRQAPGKGLEWVSAISRWGASTYYADSVKGRFTISRDNSKNTL
YLQMNSLRAEDTAVYYCGKEPFRYDYWGQGTLVTVSS (SEQ ID NO: 257)

BMS3h-38-211
EVQLLASGGGLVQPGGSLRLSCAASGFTFEEEEMIWVRQAPGKGLEWVSAISRQGGSTYYADSVKGRFTISRDNSKNTL
YLQMNSLRAEDTAVYYCGKEPFRYDYWGQGTLVTVSS (SEQ ID NO: 258)

BMS3h-38-212
EVQLLASGGGLVQPGGSLRLSCAASGFTFEEEEMIWVRQAPGKGLEWVSAISVSGWSTYYADSVKGRFTISRDNSKNTL
YLQMNSLRAEDTAVYYCGKEPFRYDYWGQGTLVTVSS (SEQ ID NO: 259)

BMS3h-38-213
EVQLLASGGGLVQPGGSLRLSCAASGFTFEEEEMIWVRQAPGKGLEWVSAISRWGWSTYYADSVKGRFTISRDNSKNTL
YLQMNSLRAEDTAVYYCGKEPFRYDYWGQGTLVTVSS (SEQ ID NO: 260)

BMS3h-38-214
EVQLLASGGGLVQPGGSLRLSCAASGFTFEEEEMIWVRQAPGKGLEWVSAISRNGLSTYYADSVKGRFTISRDNSKNTL
YLQMNSLRAEDTAVYYCGKEPFRYDYWGQGTLVTVSS (SEQ ID NO: 261)

BMS3h-38-215
EVQLLASGGGLVQPGGSLRLSCAASGFTFEEEEMIWVRQAPGKGLEWVSAISGLGWSTYYADSVKGRFTISRDNSKNTL
YLQMNSLRAEDTAVYYCGKEPFRYDYWGQGTLVTVSS (SEQ ID NO: 262)

BMS3h-38-216
EVQLLASGGGLVQPGGSLRLSCAASGFTFEEEEMIWVRQAPGKGLEWVSAISALGWSTYYADSVKGRFTISRDNSKNTL
YLQMNSLRAEDTAVYYCGKEPFRYDYWGQGTLVTVSS (SEQ ID NO: 263)

BMS3h-38-217
EVQLLASGGGLVQPGGSLRLSCAASGFTFEEEEMIWVRQAPGKGLEWVSAISRRGYSTYYADSVKGRFTISRDNSKNTL
YLQMNSLRAEDTAVYYCGKEPFRYDYWGQGTLVTVSS (SEQ ID NO: 264)

BMS3h-38-218
EVQLLASGGGLVQPGGSLRLSCAASGFTFEEEEMIWVRQAPGKGLEWVSAISRHGWSTYYADSVKGRFTISRDNSKNTL
YLQMNSLRAEDTAVYYCGKEPFRYDYWGQGTLVTVSS (SEQ ID NO: 265)

BMS3h-38-219
EVQLLASGGGLVQPGGSLRLSCAASGFTFEEEEMIWVRQAPGKGLEWVSSISRSGGSTYYADSVKGRFTISRDNSKNTL
YLQMNSLRAEDTAVYYCGKEPFRYDYWGQGTLVTVSS (SEQ ID NO: 266)

BMS3h-38-220
EVQLLASGGGLVQPGGSLRLSCAASGFTFEEEEMIWVRQAPGKGLEWVSAISRIGNSTYYADSVKGRFTISRDNSKNTL
YLQMNSLRAEDTAVYYCGKEPFRYDYWGQGTLVTVSS (SEQ ID NO: 267)

BMS3h-38-221
EVQLLASGGGLVQPGGSLRLSCAASGFTFEEEEMIWVRQAPGKGLEWVSAISGHGWSTYYADSVKGRFTISRDNSKNTL
YLQMNSLRAEDTAVYYCGKEPFRYDYWGQGTLVTVSS (SEQ ID NO: 268)

TABLE 3-continued

Anti-Human CD40 Variable Domain Amino Acid Sequences

BMS3h-38-222
EVQLLASGGGLVQPGGSLRLSCAASGFTFEEEEMIWVRQAPGKGLEWVSAISRWGGSTYYADSVKGRFTISRDNSKNTL
YLQMNSLRAEDTAVYYCGKEPFRYDYWGQGTLVTVSS (SEQ ID NO: 269)

BMS3h-38-223
EVQLLASGGGLVQPGGSLRLSCAASGFTFEEEEMIWVRQAPGKGLEWVSAISGSGGSTYYADSVKGRFTISRDNSKNTL
YLQMNSLRAEDTAVYYCGKEPFMYDYWGQGTLVTVSS (SEQ ID NO: 270)

BMS3h-38-224
EVQLLASGGGLVQPGGSLRLSCAASGFTFEEEEMIWVRQAPGKGLEWVSAISGSGGSTYYADSVKGRFTISRDNSKNTL
YLQMNSLRAEDTAVYYCGKEPFPYDYWGQGTLVTVSS (SEQ ID NO: 271)

BMS3h-38-225
EVQLLASGGGLVQPGGSLRLSCAASGFTFEEEEMIWVRQAPGKGLEWVSAISGSGGGTYYADSVKGRFTISRDNSKNTL
YLQMNSLRAEDTAVYYCGKEPFRYDYWGQGTLVTVSS (SEQ ID NO: 272)

BMS3h-38-226
EVQLLASGGGLVQPGGSLRLSCAASGFTFEEEEMIWVRQAPGKGLEWVSAISGSGGSTYYADSVKGRFTISRDNSKNTL
YLQMNSLRAEDTAVYYCGKEPLYYDYWGQGTLVTVSS (SEQ ID NO: 273)

BMS3h-38-227
EVQLLASGGGLVQPGGSLRLSCAASGFTFEEEEMIWVRQAPGKGLEWVSAISGSGGSTYYADSVKGRFTISRDNSKNTL
YLQMNSLRAEDTAVYYCGKEPMYYDYWGQGTLVTVSS (SEQ ID NO: 274)

BMS3h-38-228
EVQLLASGGGLVQPGGSLRLSCAASGFTFEEEEMIWVRQAPGKGLEWVSAISRNGFSTYYADSVKGRFTISRDNSKNTL
YLQMNSLRAEDTAVYYCGKEPFRYDYWGQGTLVTVSS (SEQ ID NO: 275)

BMS3h-38-229
EVQLLASGGGLVQPGGSLRLSCAASGFTFEEEEMIWVRQAPGKGLEWVSAISRTGGSTYYADSVKGRFTISRDNSKNTL
YLQMNSLRAEDTAVYYCGKEPFRYDYWGQGTLVTVSS (SEQ ID NO: 276)

BMS3h-38-230
EVQLLASGGGLVQPGGSLRLSCAASGFTFEEEEMIWVRQAPGKGLEWVSAISREGGSTYYADSVKGRFTISRDNSKNTL
YLQMNSLRAEDTAVYYCGKEPFRYDYWGQGTLVTVSS (SEQ ID NO: 277)

BMS3h-38-231
EVQLLASGGGLVQPGGSLRLSCAASGFPFEEEEMIWVRQAPGKGLEWVSAISRQGWSTYYADSVKGRFTISRDNSKNTL
YLQMNSLRAEDTAVYYCGKEPFRYDYWGQGTLVTVSS (SEQ ID NO: 278)

BMS3h-38-232
EVQLLASGGGLVQPGGSLRLSCAASGFTFEEEEMIWVRQAPGKGLEWVSAISRGGGSTYYADSVKGRFTISRDNSKNTL
YLQMNSLRAEDTAVYYCGKEPFRYDYWGQGTLVTVSS (SEQ ID NO: 279)

BMS3h-38-233
EVQLLASGGGLVQPGGSLRLSCAASGFTFEEEEMIWVRQAPGKGLEWVSAISRTGYSTYYADSVKGRFTISRDNSKNTL
YLQMNSLRAEDTAVYYCGKEPFRYDYWGQGTLVTVSS (SEQ ID NO: 280)

BMS3h-38-234
EVQLLASGGGLVQPGGSLRLSCAASGFTFEEEEMIWVRQAPGKGLEWVSAISRNGRSTYYADSVKGRFTISRDNSKNTL
YLQMNSLRAEDTAVYYCGKEPFRYDYWGQGTLVTVSS (SEQ ID NO: 281)

BMS3h-38-235
EVQLLASGGGLVQPGGSLRLSCAASGFTFEEEEMIWVRQAPGKGLEWVSAISRNGYSTYYADSVKGRFTISRDNSKNTL
YLQMNSLRAEDTAVYYCGKEPFRYDYWGQGTLVTVSS (SEQ ID NO: 282)

BMS3h-38-236
EVQLLASGGGLVQPGGSLRLSCAASGFTFEEEEMIWVRQAPGKGLEWVSAISRKGSSTYYADSVKGRFTISRDNSKNTL
YLQMNSLRAEDTAVYYCGKEPFRYDYWGQGTLVTVSS (SEQ ID NO: 283)

BMS3h-38-237
EVQLLASGGGLVQPGGSLRLSCAASGFTFEEEEMIWVRQAPGKGLEWVSAISRGGWSTYYADSVKGRFTISRDNSKNTL
YLQMNSLRAEDTAVYYCGKEPFRYDYWGQGTLVTVSS (SEQ ID NO: 284)

BMS3h-38-238
EVQLLASGGGLVQPGGSLRLSCAASGFTFEEEEMIWVRQAPGKGLEWVSAISRSGYSTYYADSVKGRFTISRDNSKNTL
YLQMNSLRAEDTAVYYCGKEPFRYDYWGQGTLVTVSS (SEQ ID NO: 285)

BMS3h-38-239
EVQLLASGGGLVQPGGSLRLSCAASGFTFEEEEMIWVRQAPGKGLEWVSAISRNGMSTYYADSVKGRFTISRDNSKNTL
YLQMNSLRAEDTAVYYCGKEPFRYDYWGQGTLVTVSS (SEQ ID NO: 286)

BMS3h-38-240
EVQLLESGGGLVQPGGSLRLSCAASGFTFEEEEMIWVRQAPGKGLEWVSAISRNGYSTYYADSVKGRFTISRDNSKNTL
YLQMNSLRAEDTAVYYCGKEPFRYDYWGQGTLVTVSS (SEQ ID NO: 287)

TABLE 3-continued

Anti-Human CD40 Variable Domain Amino Acid Sequences

BMS3h-41-1
EVQLLESGEGLVQPGGSLRLSCAASGFTFTEHEMIWVRQAPGKGLEWVSSISGNGANTYYADSVKGRFTISRDNSKNTL
YLQMNSLRPEDTAVYYCAKEPLRFDYWGQGTLVTVSS (SEQ ID NO: 288)

BMS3h-41-2
EVQLLESGGGLVQPGGSLRLSCAASGSTFTEYEMIWVRQAPGKGLEWISSISGNGANTYYADSVKGRFTISRDNSKNTL
YLQMNSLRAEDTAVYFCAKEPLRFDYRGQGTLVTVSS (SEQ ID NO: 289)

BMS3h-41-3
EVQLLEPGGGLVQPGGSLRLSCAASGFTFTEYEMIWVRKAPGKGMEWVSSISGNGANTYYADSVKGRFTISRDNSKNML
YLQMNSLRAEDTAVYYCAKEPLRFGYWGQGTLVTVSS (SEQ ID NO: 290)

BMS3h-41-4
EVQLLDSGGGLVQPGGSLRLSCAASGFTFTEYEMIWVRQAPGKGLEWVSSISGNGANTYYADSVKGRFTISRDNSKNTL
YLQMNSLRAEDTAVYYCAKEPLRFDYWGRGTLVTVSS (SEQ ID NO: 291)

BMS3h-41-5
EVQLLGSGGGLVQPGGSLRLSCAASGFTFTEYEMIWVRQAPGKSLEWVSSISGNGANTYYADSVKGRFTISRDNSKNTL
YLQMNSLRAEDTAVYYCAKEPLRYDDWGQGTLVTVSS (SEQ ID NO: 292)

BMS3h-41-6
EVQPLESGGGLVQPGGSLRLSCSASGFTFNEYEMIWVRQAPGKGLEWVSSISGNGANTYYADSVKGRFTISRDNSKNTL
YLQMNSLRAEDTAVYYCAKEPLRFDYWGQGTLVTVSS (SEQ ID NO: 293)

BMS3h-41-7
EVQLLESGEGLVQPGGSLRLSCAASGFTFAEYEMIWVRQAPGKGLEWVSSISGNGANTYYADSVKGRFTISRDNSKNTL
YLQMNSLRAEDTAVYYCAKEPLRFDYWGQGTLVTVSS (SEQ ID NO: 294)

BMS3h-41-8
EVQLLDPGGGLVQPGGSLRLSCAASGFTFTESEMIWVRQAPGKGLEWVSSISGNGANTYYADSVKGRFTISRDNSKNTL
YLQMNSLRAEDTAVYYCAKEPLRFDYWGQGTLVTVSS (SEQ ID NO: 295)

BMS3h-41-9
EVQLLEPGGGLVQPGGSLRLSCAASGFTFTEYEMIWVRKAPGKGMEWVSSISGNGANTYYADSVKGRFTISRDNSKNTL
YLQMNSLRPEDTAVYYCAKEPLRFDDWGQGTLVTVSS (SEQ ID NO: 296)

BMS3h-41-10
EVQLLESGVGLVQPGGSLRLSCAASGFTFTEYEMIWVRKAPGKGLEWVSSISGNGANTYYADSVKGRFTISRDNSKNTL
YLQMNSLRAEDTAVYYCAKEPLRFDNWGQGTLVTVSS (SEQ ID NO: 297)

BMS3h-41-11
EVQLLESRGGLVQPGGSLRLSCAASGFTFTEHEMIWVRQAPGKGLEWVSSISGNGANTYYADSVKGRFSVSRDNSKNTL
YLQMNSLRAEDTAVYYCAKEPLRFDYWGQGTLVTVSS (SEQ ID NO: 298)

BMS3h-41-12
EVQPLESGGGLVQPGGSLRLSCAASGFTFTEYEMIWVRQAPGKGLEWVSSISGNGANTYYADSVKGRFTISRDNSKNTL
YLQMNSLRAEDTAVYYCAKEPLRFDYWGQGTLVTVSS (SEQ ID NO: 299)

BMS3h-41-13
EVQLLESAGGLVQPGGSLRLSCAASGFTFAEYEMIWVRQAPGKGLEWVSSISGNGANTYYADSVKGRFTISRDNSKNTL
YLQMNSLRAEDTAVYYCAKEPLRFDYWGQGALVTVSS (SEQ ID NO: 300)

BMS3h-41-14
EVQLLEPGGGLVQPGGSLRLSCAASGFTFTEYEMIWVRQAPGKGLEWVSSISGNGANTYYADSVKGRFTISRDNSKNTL
YLQMNSLRAEDTAVYYCAKEPLRFDNWGQGTLVTVSS (SEQ ID NO: 301)

BMS3h-43-1
EVQLLESGGGLVQPGGSLRLSCTASGFTFNMYEMSWVRQAPGKGLEWVSGISRRGFTTYYADSVKGRFTISRDNSKNTL
YLQMNSLRAEDTAVYYCAKEPITYDLRYARFDYSGQGTLVTVSS (SEQ ID NO: 302)

BMS3h-43-2
EEQLLESGGGLVQPGGSLRLSCTASGFTFNMYEMSWVRQAPGKGLEWVSGISRRGFTTYYADSVKGRFTISRDNSKNTL
YLQMNSLRAEDTAVYYCAKEPITYATRYARFDYWGQGTLVTVSS (SEQ ID NO: 303)

BMS3h-43-3
EVQLLESGGGLVQPGGSLRLSCTASGFTFNMYEMSWVRQAPGKGLEWVSGISRRGFTTYYADSVKGRFTISRDNFKNTL
YLQMNSLRAEDTAVYYCAKEPITYDMRYARFDYGGQGTLVTVSS (SEQ ID NO: 304)

BMS3h-43-4
EVQLLESGGGLVQPGGSLRLSCTASGFTFNMYEMSWVRQAPGKGLEWVSGISRRGFTTYYADSVKGRFTISRDNSKNTL
YLQMNSLRAEDTAVYYCAKEPITYDMRYARFDNWGQGTLVTVSN (SEQ ID NO: 305)

BMS3h-43-5
EVQLLESGGGLVQPGGSLRLSCTASGFTFNTYEMSWVRQAPGKGLEWVSGIGRRGFTTYYADSVKGRFTISRDNSKNTL
YLQMNSLRAEDTAVYYCAKEPITYDLRYARFDYSGQGTLVTVSS (SEQ ID NO: 306)

TABLE 3-continued

Anti-Human CD40 Variable Domain Amino Acid Sequences

BMS3h-43-6
EVQLMESGGGLVQPGGSLRLSCTASGFSFNMYEMSWVRQAPGKGLEWVSGISRRGYTTYYADSVKGRFTISRDNSKNTL
YLQMNSLRAEDTAVYYCAKEPITYDMRYARFDYWGRGTLVTVSS (SEQ ID NO: 307)

BMS3h-43-7
EVQLLESGGGLVQPGGSLRLSCTASGFAFNMYEMSWVRQAPGKGLEWVSGISRHGFTTYYADSVKGRFTVSRDNSKNTL
YLQMNSLRAEDTAVYYCAKEPITYDMRYARSDYWGQGTLVTVSS (SEQ ID NO: 308)

BMS3h-43-8
EVQLLESGGGLVQPGGSLRLSCTASGFTFNMYEMSWVRQAPGKGLEWVSGISRRGFTTYYADSVKGRFTISRDNSKNTL
YLQMNSLRAEDTAVYFCAKEPITYDMRYARSDYWGQGTLVTVSS (SEQ ID NO: 309)

BMS3h-43-9
EVQLLESGGGLVQPGGSLRLSCTASGFTFNIWEMSWVRQAPGKGLEWVSGISRRGFTTYYADSVKGRFTISRDNSKNTL
YLQMNSLRAEDTAVYYCAKEPITYSMRYARFDYSGLGTMVTVSS (SEQ ID NO: 310)

BMS3h-43-10
EVQLLESGGGLVQPGGSLRLSCTASGFTFNMYEMSWVRQAPGKGLEWVSGISRRGFTTYYADSVKGRFTISRDNSKNTL
YLQMNSLRAEDTAVYYCAKEPITYDMRYARFDYSGQGTLVTVSS (SEQ ID NO: 311)

BMS3h-43-11
EVQLLESGGGLVQPGGSLRLSCTASGFTFNMYEMSWVRKAPGKGLEWVSGISRHGFTTYYADSVKGRFTISRDNSKNTL
YLQMNSLRAEDTAVYYCAKEPITYDMRYARFDYWGQGTLVTVSS (SEQ ID NO: 312)

BMS3h-43-12
EVQLFESGGGLVQPGGSLRLSCTASGFTFNMYEMSWVRQAPGKGLEWVSGISRRGFTTYYADSVKGRFTISRDNSKNTL
YLQMNSLRAEDTAVYYCAKEPITYDMRYARFDYWGRGTLVTVSS (SEQ ID NO: 313)

BMS3h-43-13
EVQLLESGGGLVQPGGSLRLSCTASGFTFNMYEMSWVRQAPGKGLEWVSGISRRGFTTYYADSVKGRFTISRDNSKNTL
YLQMNSLRAEDTAVYYCAKEPITYDMRYARFDYWGRGTLVTVSS (SEQ ID NO: 314)

BMS3h-43-14
EVQLLESGGGSVQPGGSLRLSCTASGFSFNMYEMSWVRQAPGKGLEWVSGISRRGFTTYYADSVKGRFTISRDNSKNTL
YLQMNSLRAEDTAVYYCAKEPITYDMRYARFDYWGQGTLVTVSG (SEQ ID NO: 315)

BMS3h-43-15
EVQLLESGGGLVQPGGSLRLSCTASGFTFNMYEMSWVRKAPGKGLEWVSGISRRGFTTYYADSVKGRFTISRDNSKNTL
YLQMNSLRAEDTAVYYCAKEPITYDMRYARFDYWGQGTLVTVSS (SEQ ID NO: 316)

BMS3h-56-1
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFTFEDWGQGTLVTVSS (SEQ ID NO: 317)

BMS3h-56-2
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFTFDDWGQGTLVTVSS (SEQ ID NO: 318)

BMS3h-56-3
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCTKLPFIFEYWGQGTLVTVSS (SEQ ID NO: 319)

BMS3h-56-4
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFMFDDRGQGTLVTVSS (SEQ ID NO: 320)

BMS3h-56-5
EVQLLESGGGLVQPGGSLRLSCAASGFTFRDYEMWWVRQAPGKGLERVSAINPQGTRTYYADSVMGRFTISRDNSKNTL
YLQMNSLRAEDTAVYYCAKLPFTFDDWGQGTLVTVSS (SEQ ID NO: 321)

BMS3h-56-6
EVQLLESGGGLVQPGGSLRLSCAASGFSFRDYEMWWVRQAPGKGLERVSAINPQGTRTYYADSVKGRFTISRDNSKNTL
YLQMNSLRAEDTAVYYCAKLPFIFDNRGQGTLVTVSS (SEQ ID NO: 322)

BMS3h-56-7
EVQLLESGGGLVQPGGSLRLSCAASGFTFRDYEMWWVRQAPGKGLERVSAINPQGTRTYYADSVKGRFTISRDNSKNTL
YLQMNSLRAEDTSVYHCAKPPFIFGDWGPGTLVTVSS (SEQ ID NO: 323)

BMS3h-56-8
EVQLLESGGGLVQPGGSRRLSCAASGFTFRDYEMWWVRQAPGKGLERVSAINPQGTRTYYADSVKGRFTISRDNSKNTL
YLQMNSLRAEDTAVYYCAKLPFTFEDWGQGTLVTVSS (SEQ ID NO: 324)

BMS3h-56-9
EVQLLESGGGLVQPGGSLRLSCAASGFTFRDYEMWWVRQAPGKGLERVSAINPQGTRTYYADSVMGRFTISRDNSKNTL
YLQMNSLRAEDTAVYYCAKLPFMFDDRGQGTLVTVSS (SEQ ID NO: 325)

TABLE 3-continued

Anti-Human CD40 Variable Domain Amino Acid Sequences

BMS3h-56-10
EVQLLESGGGLVQPGGSLRLSCAASGFTFRDYEMWWVRQAPGKVLERVSAINPQGTRTYYADSVKGRFTISRDNSKNML
YLQMNSLRAEDTAVYYCAKLPFMFDDRGQGTLVTVSS (SEQ ID NO: 326)

BMS3h-56-11
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFMFDDRGQGTLVTVSS (SEQ ID NO: 327)

BMS3h-56-12
EVQLLESGGGLIQPGGSLRLSCAASGFTFRDYEMWWVRQAPGKGLERVSAINPQGTRTYYADSVKGRFTISRDNSKNTL
YLQMNSLRAEDTAVYYCLKLPFIFDYWGQGTLVTVSS (SEQ ID NO: 328)

BMS3h-56-13
EVQLLESGGGLVQPGGSLRLSCAASGFTFRDYEMWWVRQAPGKGLERVSAINPQGTRTYYADSVKGRFTISRDNSKNTL
YLQMNSLRADDTAVYHCTKLPFIFDYWGQGTLVTVSS (SEQ ID NO: 329)

BMS3h-56-14
EVQLLESGGGLVQPGGSLRLSCAASGFTFRDYEMWWVRQAPGMVLERVSAINPQGTRTYYADSVKGRFTISRDNSKNTL
YLQMNSLRAEDTAVYYCAKLPFFFDSRGQGTLVTVSS (SEQ ID NO: 330)

BMS3h-56-15
EVQLLESGGGLVQPGGSLRLSCAASGFTFRDYEMWWVRRAPGKGLERVSAINPQGTRTYYADSVKGRFTISRDNSKNTL
YLQMNSLRAEDTAVYYCAKLPFTFEDWGQGTLVTVSS (SEQ ID NO: 331)

BMS3h-56-16
EVQLLESGGGLVQPGGSLRLSCAASGFTFRDYEMWWVRQAPGKGLERVSAINPQGTRTYYADSVMGRFTISRDNSKNTL
YLQMNSLRAEDTAVYYCAKLPFTFEDWGQGTLVTVSS (SEQ ID NO: 332)

BMS3h-56-17
EVQLLESGGGLVQPGGSLRLSCAASGFSFRDYEMWWYRQAPGKGLERVSAINPQGTRTYYADSVKGRFTISRDNSKNTL
YLQMNSLRAEDTAVYYCAKLPFTFEDWGQGTLVTVSS (SEQ ID NO: 333)

BMS3h-56-18
EVQLLESGGGLVQPGGSLRLSCAASGFTFRDYEMWWVRQAPGKVLERVSAINPQGTRTYYADSVKGRFTISRDNSKNML
YLQMNSLRAEDTAVYYCAKLPFTFEDWGQGTLVTVSS (SEQ ID NO: 334)

BMS3h-56-19
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYHCAKLPFTFEDWGQGTLVTVSS (SEQ ID NO: 335)

BMS3h-56-20
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCTKLPFTFEDWGQGTLVTVSS (SEQ ID NO: 336)

BMS3h-56-21
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCLKLPFTFEDWGQGTLVTVSS (SEQ ID NO: 337)

BMS3h-56-22
EVQLLESGGGLVQPGGSLRLSCAASGFTFRDYEMWWVRQAPGKGLERVSAINPQGTRTYYADSVKGRFTISRDNSKNTL
YLQMNSLRADDTAVYHCTKLPFIFEYWGQGTLVTVSS (SEQ ID NO: 338)

BMS3h-56-23
EVQLLESGGGLVQPGGSLRLSCAASGFTFRDYEMWWVRQAPGKGLERVSAINPQGTRTYYADSVMGRFTISRDNSKNTL
YLQMNSLRAEDTAVYYCAKEPYSFDSWGQGTLVTVSS (SEQ ID NO: 339)

BMS3h-56-24
EVQLLESGGGLVQPGGSLRLSCAASGFTFRDYEMWWVRQAPGKGLERVSAINPQGTRTYYADSVMGRFTISRDNSKNTL
YLQMNSLRAEDTAVYHCAKEPYSYDYWGQGTLVTVSS (SEQ ID NO: 340)

BMS3h-56-25
EVQLLESGGGLVQPGGSLRLSCAASGFTFRDYEMWWVRRAPGKGLERVSAINPQGTRTYYADSVMGRFTISRDNSKNTL
YLQMNSLRAEDTAVYYCAKLPFTFDDWGQGTLVTVSS (SEQ ID NO: 341)

BMS3h-56-26
EVQLLESGGGLVQPGGSLRLSCAASGFTFRDYEMWWVRRAPGKGLERVSAINPQGTRTYYADSVMGRFTISRDNSKNTL
YLQMNSLRAEDTAVYYCAKLPFMFDDRGQGTLVTVSS (SEQ ID NO: 342)

BMS3h-56-27
EVQLLESGGGLVQPGGSLRLSCAASGFTFRDYEMWWVRQAPGKGLERVSAINPQGTRTYYADSVMGRFTISRDNSKNTL
YLQMNSLRAEDTAVYYCAKLPFMFDDWGQGTLVTVSS (SEQ ID NO: 343)

BMS3h-56-28
EVQLLESGGGLVQPGGSLRLSCAASGFTFAGYELWWVRQAPGKGLERVSAINPQGTRTYYADSVMGRFTISRDNSKNTL
YLQMNSLRAEDTAVYYCAKLPFTFDDWGQGTLVTVSS (SEQ ID NO: 344)

TABLE 3-continued

Anti-Human CD40 Variable Domain Amino Acid Sequences

BMS3h-56-29
EVQLLESGGGLVQPGGSLRLSCAASGFTFAGYELWWVRQAPGKGLERVSAINPQGTRTYYADSVMGRFTISRDNSKNTL
YLQMNSLRAEDTAVYYCAKLPFMFDDRGQGTLVTVSS (SEQ ID NO: 345)

BMS3h-56-30
EVQLLESGGGLVQPGGSLRLSCAASGFTFAGYEMWWFRQAPGKGLERVSAINPQGTRTYYADSVMGRFTISRDNSKNTL
YLQMNSLRAEDTAVYYCAKLPFTFDDWGQGTLVTVSS (SEQ ID NO: 346)

BMS3h-56-31
EVQLLESGGGLVQPGGSLRLSCAASGFTFAGYEMWWFRQAPGKGLERVSAINPQGTRTYYADSVMGRFTISRDNSKNTL
YLQMNSLRAEDTAVYYCAKLPFMFDDRGQGTLVTVSS (SEQ ID NO: 347)

BMS3h-56-32
EVQLLESGGGLVQPGGSLRLSCAASGFTFRDYEMWWVRQAPGKGLEWVSAINPQGTRTYYADSVMGRFTISRDNSKNTL
YLQMNSLRAEDTAVYYCAKLPFTFDDWGQGTLVTVSS (SEQ ID NO: 348)

BMS3h-56-33
EVQLLESGGGLVQPGGSLRLSCAASGFTFRDYEMWWVRQAPGKGLEWVSAINPQGTRTYYADSVMGRFTISRDNSKNTL
YLQMNSLRAEDTAVYYCAKLPFMFDDRGQGTLVTVSS (SEQ ID NO: 349)

BMS3h-56-202
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPTYFSDRGQGTLVTVSS (SEQ ID NO: 350)

BMS3h-56-203
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFFFEEWGQGTLVTVSS (SEQ ID NO: 351)

BMS3h-56-204
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPTYFKDWGQGTLVTVSS (SEQ ID NO: 352)

BMS3h-56-205
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFYFSEWGQGTLVTVSS (SEQ ID NO: 353)

BMS3h-56-206
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYHCAKLPMFFEDWGQGTLVTVSN (SEQ ID NO: 354)

BMS3h-56-207
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFPFSEWGQGTLVTVSS (SEQ ID NO: 355)

BMS3h-56-208
EVQLLESGGGLVQPGGSLRLSCAASGFTFRDYEMWWVRQAPGKGLERVSAINPQGTRTYYADSVKGRFTISRDNSKNTL
YLQMDSLRAEDTAVYYCAKLPFYFSEWGQGTLVTVSS (SEQ ID NO: 356)

BMS3h-56-209
EVQLLESGGGLVQPGGSLRLSCAASGFTFRDYEMWWVRQAPGKGLERVSAINPYGNLTYYADSVKGRFTISRDNSKNTL
YLQMNSLRAEDTAVYYCAKLPFTFEDWGQGTLVTVSS (SEQ ID NO: 357)

BMS3h-56-210
EVQLLESGGGLVQPGGSLRLSCAASGFTFRDYEMWWVRQAPGKGLERVSAINPPGTLTYYADSVKGRFTISRDNSKNTL
YLQMNSLRAEDTAVYYCAKLPFTFEDRGQGTLVTVSS (SEQ ID NO: 358)

BMS3h-56-211
EVQLLESGGGLVQPGGSLRLSCAASGFTFRDYEMWWVRQAPGKGLERVSAINPWGGLTYYADSVKGRFTISRDNSKNTL
YLQMNSLRAEDTAVYYCAKLPFTFEDWGQGTLVTVSS (SEQ ID NO: 359)

BMS3h-56-212
EVQLLESGGGLVQPGGSLRLSCAASGFTFRDYEMWWVRQAPGKGLERVSAINPMGGFTYYADSVKGRFTISRDNSKNTL
YLQMNSLRAEDTAVYYCAKLPFTFEDWGQGTLVTVSS (SEQ ID NO: 360)

BMS3h-56-213
EVQLLESGGGLVQPGGSLRLSCAASGFTFRDYEMWWVRQAPGKGLERVSAINPWGSHTYYADSVKGRFTISRDNSKNTL
YLQMNSLRAEDTAVYYCAKLPFTFEDWGQGTLVTVSS (SEQ ID NO: 361)

BMS3h-56-214
EVQLLESGGGLVQPGGSLRLSCAASGFTFRDYEMWWVRQAPGKGLERVSAINPSGGLTYYADSVKGRFTISRDNSKNTL
YLQMNSLRAEDTAVYYCAKLPFTFDDRGQGTLVTVSS (SEQ ID NO: 362)

BMS3h-56-215
EVQLLESGGGLVQPGGSLRLSCAASGFTFRDYEMWWVRQAPGKGLERVSAINPHGSLTYYADSVKGRFTISRDNSKNTL
YLQMNSLRAEDTAVYYCAKLPFTFDDWGQGTLVTVSS (SEQ ID NO: 363)

TABLE 3-continued

Anti-Human CD40 Variable Domain Amino Acid Sequences

BMS3h-56-216
EVQLLESGGGLVQPGGSLRLSCAASGFTFRDYEMWWVRQAPGKGLERVSAINPAGRLTYYADSVKGRFTISRDNSKNTL
YLQMNSLRAEDTAVYYCAKLPFTFEDWGQGTLVTVSS (SEQ ID NO: 364)

BMS3h-56-217
EVQLLESGGGLVQPGGSLRLSCAASGFTFRDYEMWWVRQAPGKGLERVSAINPWGSLTYYADSVKGRFTISRDNSKNTL
YLQMNSLRAEDTAVYYCAKLPFTFEDWGQGTLVTVSS (SEQ ID NO: 365)

BMS3h-56-218
EVQLLESGGGLVQPGGSLRLSCAASGFTFPDYEMWWVRQAPGKGLERVSAINPQGTRTYYADSVKGRFTISRDNSKNTL
YLQMNSLRAEDTAVYHCAKLPFTFDDWGQGTLVTVSS (SEQ ID NO: 366)

BMS3h-56-219
EVQLLESGGGLVQPGGSLRLSCADSGFTFPPVEMWWVRQAPGKGLERVSAINPQGTRTYYADSVKGRFTISRDNSKNTL
YLQMNSLRAEDTAVYYCAKLPFTFEDWGQGTLVTVSS (SEQ ID NO: 367)

BMS3h-56-220
EVQLLESGGGLVQPGGSLRLSCAASGFTFRDYEMWWVRQAPGKGLERVSAINPYGGLTYYADSVKGRFTISRDNSKNTL
YLQMNSLRAEDTAVYYCAKLPFTFDDWGQGTLVTVSS (SEQ ID NO: 368)

BMS3h-56-221
EVQLLESGGGLVQPGGSLRLSCAASGFTFRDYEMWWVRQAPGKGLERVSAINPWGNHTYYADSVKGRFTISRDNSKNTL
YLQMNSLRAEDTAVYYCAKLPFTFEDWGQGTLVTVSS (SEQ ID NO: 369)

BMS3h-56-222
EVQLLESGGGLVQPGGSLRLSCAASGFTFRDYEMWWVRQAPGKGLERVSAINPHGGYTYYADSVKGRFTISRDNSKNTL
YLQMNSLRAEDTAVYYCAKLPFTFEDWGQGTLVTVSS (SEQ ID NO: 370)

BMS3h-56-223
EVQLLESGGGLVQPGGSLRLSCAASGFTFRDYEMWWVRQAPGRGLERVSAINPPGMLTYYADSVKGRFTISRDNSKNTL
YLQMNSLRAEDTAVYYCAKLPFTFDDWGQGTLVTVSS (SEQ ID NO: 371)

BMS3h-56-224
EVQLLESGGGLVQPGGSLRLSCAASGFTFRDYEMWWVRQAPGKGLERVSAINPWGQLTYYADSVKGRFTISRDNSKNTL
YLQMNSLRAEDTAVYYCAKLPFTFEDWGQGTLVTVSS (SEQ ID NO: 372)

BMS3h-56-225
EVQLLESGGGLVQPGGSLRLSCAASGFTFRDYEMWWVRQAPGKGLERVSAINPWGGYTYYADSVKGRFTISRDNSKNTL
YLQMNSLRAEDTAVYYCAKLPFTFDDWGQGTLVTVSS (SEQ ID NO: 373)

BMS3h-56-226
EVQLLESGGGLVQPGGSLRLSCAASGFTFRDYEMWWVRQAPGKGLERVSAINPSGGLTYYADSVKGRFTISRDNSKNTL
YLQMNSLRAEDTAVYYCAKLPFTFEDWGQGTLVTVSS (SEQ ID NO: 374)

BMS3h-56-227
EVQLLESGGGLVQPGGSLRLSCAASGFTFRDYEMWWVRQAPGKGLERVSAINPSGGLTYYADSVKGRFTISRDNSKNTL
YLQMNSLRAEDTAVYYCAKLPFTFDDWGQGTLVTVSS (SEQ ID NO: 375)

BMS3h-56-228
EVQLLESGGGLVQPGGSLRLSCAASGFTFRDYEMWWVRQAPGKGLERVSAINPSGTLTYYADSVKGRFTISRDNSKNTL
YLQMNSLRAEDTAVYYCAKLPFTFEDWGQGTLVTVSS (SEQ ID NO: 376)

BMS3h-56-229
EVQLLESGGGLVQPGGSLRLSCAASGFTFRDYEMWWVRQAPGKGLERVSAINPYGSLTYYADSVKGRFTISRDNSKNTL
YLQMNSLRAEDTAVYYCAKLPFTFDDWGQGTLVTVSS (SEQ ID NO: 377)

BMS3h-56-230
EVQLLESGGGLVQPGGSLRLSCAASGFTFRDYEMWWVRQAPGKGLERVSAINPWGGYTYYADSVKGRFTISRDNSKNTL
YLQMNSLRAEDTAVYYCAKLPFTFEDWGQGTLVTVSS (SEQ ID NO: 378)

BMS3h-56-231
EVQLLESGGGLVQPGGSLRLSCAASGFTFRDYEMWWVRQAPGKGLERVSAINPQGGLTYYADSVKGRFTISRDNSKNTL
YLQMNSLRAEDTAVYYCAKLPFTFEDWGQGTLVTVSS (SEQ ID NO: 379)

BMS3h-56-232
EVQLLESGGGLVQPGGSLRLSCAASGFTFRDYEMWWVRQAPGKGLERVSAINPWGSHTYYADSVKGRFTISRDNSKNTL
YLQMNSLRAEDTAVYYCAKLPFTFDDWGQGTLVTVSS (SEQ ID NO: 380)

BMS3h-56-233
EVQLLESGGGLVQPGGSLRLSCAASGFTFRDYEMWWVRQAPGKGLERVSAINPWGTLTYYADSVKGRFTISRDNSRNTL
YLQMNSLRAEDTAVYYCAKLPFTFDDWGQGTLVTVSS (SEQ ID NO: 381)

BMS3h-56-234
EVQLLESGGGLVQPGGSLRLSCAASGFTFRDYEMWWVRQAPGKGLERVSAINPNGRLTYYADSVKGRFTISRDNSKNTL
YLQMNSLRAEDTAVYYCAKLPFTFADWGQGTLVTVSS (SEQ ID NO: 382)

TABLE 3-continued

Anti-Human CD40 Variable Domain Amino Acid Sequences

BMS3h-56-235
EVQLLESGGGLVQPGGSLRLSCAASGFTFRDYEMWWVRQAPGKGLERVSAINPWGQLTYYADSVKGRFTISRDNSKNTL
YLQMNSLRAEDTAVYYCAKLPFTFDDWGQGTLVTVSS (SEQ ID NO: 383)

BMS3h-56-236
EVQLLESGGGLVQPGGSLRLSCAASGFTFRDYEMWWVRQAPGKGLERVSAINPHGGLTYYADSVKGRFTISRDNSKNTL
YLQMNSLRAEDTAVYYCAKLPFTFDDWGQGTLVTVSS (SEQ ID NO: 384)

BMS3h-56-237
EVQLLESGGGLVQPGGSLRLSCAASGFTFRDYEMWWVRQAPGKGLERVSAINPAGMLTYYADSVKGRFTISRDNSKNTL
YLQMNSLRAEDTAVYYCAKLPFTFDDWGQGTLVTVSS (SEQ ID NO: 385)

BMS3h-56-238
EVQLLESGGGLVQPGGSLRLSCAASGFTFRDYEMWWVRQAPGKGLERVSAINPHGTLTYYADSVKGRFTISRDNSKNTL
YLQMNSLRAEDTAVYYCAKLPFTFEDWGQGTLVTVSS (SEQ ID NO: 386)

BMS3h-56-239
EVQLLESGGGLVQPGGSLRLSCAASGFTFRDYEMWWVRQAPGKGLERVSAINPWGSLTYYADSVKGRFTISRDNSKNTL
YLQMNSLRAEDTAVYYCAKLPFTFDDWGQGTLVTVSS (SEQ ID NO: 387)

BMS3h-56-240
EVQLLESGGGLVQPGGSLRLSCAASGFTFRDYEMWWVRQAPGKGLERVSAINPYGGLTYYADSVKGRFTISRDNSKNTL
YLQMNSLRAEDTAVYYCAKLPFTFEDWGQGTLVTVSS (SEQ ID NO: 388)

BMS3h-56-241
EVQLLESGGGLVQPGGSLRLSCAASGFTFRDYEMWWVRQAPGKGLERVSAINPAGFLTYYADSVKGRFTISRDNSKNTL
YLQMNSLRAEDTAVYYCAKLPFTFEDWGQGTLVTVSS (SEQ ID NO: 389)

BMS3h-56-242
EVQLLESGGGLVRPGGSLRLSCAASGFTFRDYEMWWVRQAPGKGLERVSAINPYGGLTYYADSVKGRFTISRDNSKNTL
YLQMNSLRAEDTAVYYCAKLPFTFEDWGQGTLVTVSS (SEQ ID NO: 390)

BMS3h-56-243
EVQLLESGGGLVQPGGSLRLSCAASGFTFRDYEMWWVRQAPGKGLERVSAINPWGGFTYYADSVKGRFTISRDNSKNTL
YLQMNSLRAEDTAVYYCAKLPFTFEDWGQGTLVTVSS (SEQ ID NO: 391)

BMS3h-56-244
EVQLLESGGGLVQPGGSLRLSCAASGFTFRDYEMWWVRQAPGKGLERVSAINPWGGLTYYADSVKGRFTISRDNSKNTL
YLQMNSLRAEDTAVYYCAKLPFTFDDWGQGTLVTVSS (SEQ ID NO: 392)

BMS3h-56-245
EVQLLESGGGLVQPGGSLRLSCAASGFTFRDYEMWWVRQAPGKGLERVSAINPYGGLTYYADSVKGRFTISRDNSKNTL
YLQMDSLRAEDTAVYYCAKLPFTFEDWGQGTLVTVSS (SEQ ID NO: 393)

BMS3h-56-246
EVQLLESGGGLVQPGGSLRLSCAASGFTFRDYEMWWVRQAPGKGLERVSAINPWGTLTYYADSVKGRFTISRDNSKNTL
YLQMNSLRAEDTAVYYCAKLPFTFEDWGQGTLVTVSS (SEQ ID NO: 394)

BMS3h-56-247
EVQLLESGGGLVQPGGSLRLSCAASGFTFRDYEMWWVRQAPGKGLERVSAINPWGGYTYYADSVKGRFTISRDNSKNTL
YLQMNSLRAEDTAVYYCAKLPFTFEDWGRGTLVTVSS (SEQ ID NO: 395)

BMS3h-56-248
EVQLLESGGGLVQPGGSLRLSCAASGFTFRDYEMWWVRQAPGKGLERVSAINPYGNLTYYADSVKGRFTISRDNSKNTL
YLQMNSLRAEDTAVYYCAKLPFTFDDWGQGTLVTVSS (SEQ ID NO: 396)

BMS3h-56-249
EVQLLESGGGLVQPGGSLRLSCAASGFTFRDYEMWWVRQAPGKGLERVSAINPHGGFTYYADSVKGRFTISRDNSKNTL
YLQMNSLRAEDTAVYYCAKLPFTFEDWGQGTLVTVSS (SEQ ID NO: 397)

BMS3h-56-250
EVQLLESGGGLVQPGGSLRLSCAASGFTFRDYEMWWVRQAPGKGLERVSAINPAGFYTYYADSVKGRFTISRDNSKNTL
YLQMNSLRAEDTAVYYCAKLPFTFDDWGQGTLVTVSS (SEQ ID NO: 398)

BMS3h-56-251
EVQLLESGGGLVQPGGSLRLSCAASGFTFRDYEMWWVRQAPGKGLERVSAINPAGGLTYYADSVKGRFTISRDNSKNTL
YLQMNSLRAEDTAVYYCAKLPFTFDDWGQGTLVTVSS (SEQ ID NO: 399)

BMS3h-56-252
EVQLLESGGGLVQPGGSLRLSCAASGFAFRDYEMWWVRQAPGKGLERVSAINPHGSLTYYADSVKGRFTTSRDNSKNTL
YLQMNSLRAEDTAVYYCAKLPFTFEDWGQGTLVTVSS (SEQ ID NO: 400)

BMS3h-56-253
EVQLLESGGGLVQPGGSLRLSCAASGFTFRDYEMWWVRQAPGKGLERVSAINPAGGYTYYADSVKGRFTISRDNSKNTL
YLQMNSLRAEDTAVYHCAKLPFTFEDWGQGTLVTVSS (SEQ ID NO: 401)

TABLE 3-continued

Anti-Human CD40 Variable Domain Amino Acid Sequences

BMS3h-56-254
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFWFTEWGQGTLVTVSS (SEQ ID NO: 402)

BMS3h-56-255
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFMFSDRGQGTLVTVSS (SEQ ID NO: 403)

BMS3h-56-256
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFLFQEWGQGTLVTVSS (SEQ ID NO: 404)

BMS3h-56-257
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPTRFEDWGQGTLVTVSS (SEQ ID NO: 405)

BMS3h-56-258
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFYFHEWGQGTLVTVSS (SEQ ID NO: 406)

BMS3h-56-259
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCGKEPFRYDYWGQGTLVTVSS (SEQ ID NO: 407)

BMS3h-56-260
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPTFFKDWGQGTLVTVSS (SEQ ID NO: 408)

BMS3h-56-261
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFFFQEWGQGTLVTVSS (SEQ ID NO: 409)

BMS3h-56-262
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPQLFHDRGQGTLVTVSS (SEQ ID NO: 410)

BMS3h-56-263
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPQLFEDWGQGTLVTVSS (SEQ ID NO: 411)

BMS3h-56-264
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYHCAKLPFGFSEWGQGTLVTVSS (SEQ ID NO: 412)

BMS3h-56-265
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPQLFQDWGQGTLVTVSS (SEQ ID NO: 413)

BMS3h-56-266
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFFFHEWGQGTLVTVSS (SEQ ID NO: 414)

BMS3h-56-267
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPHYFKDWGQGTLVTVSS (SEQ ID NO: 415)

BMS3h-56-268
EVQLLESGGGLVQSGGSLRLSCAASGFTFRDYEMWWVRQAPGKGLERVSAINPQGTRTYYADSVKGRFTISRDNSKNTL
YLQMNSLRAEDTAVYYCAKLPFYFEEWGQGTLVTVSS (SEQ ID NO: 416)

BMS3h-56-269
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFRFSDRGQGTLVTVSS (SEQ ID NO: 417)

BMS3h-56-270
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPTLFQDWGQGTLVTVSS (SEQ ID NO: 418)

BMS3h-56-271
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFYFSEWGQGTLVTVSN (SEQ ID NO: 419)

BMS3h-56-272
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYYCAKLPFWFQEWGQGTLVTVSS (SEQ ID NO: 420)

TABLE 3-continued

Anti-Human CD40 Variable Domain Amino Acid Sequences

BMS3h-56-273
EVQLLESGGGLVQPGGSLRLSCAASGFTFRDYEMWWVRQAPGKGLERVSAINPWGSLTYYADSVKGRFTISRDNSKNTL
YLQMNSLRAEDTAVYYCAKLPFYFQEWGQGTLVTVSS (SEQ ID NO: 421)

BMS3h-56-274
EVQLLESGGGLVQPGGSLRLSCAASGFTFRDYEMWWVRQAPGKGLERVSAINPWGSLTYYADSVKGRFTISRDNSKNTL
YLQMNSLRAEDTAVYHCAKLPMFFEDWGQGTLVTVSN (SEQ ID NO: 422)

BMS3h-56-275
EVQLLESGGGLVQPGGSLRLSCAASGFTFRDYEMWWVRQAPGKGLERVSAINPWGSLTYYADSVKGRFTISRDNSKNTL
YLQMNSLRAEDTAVYYCAKLPFYFHEWGQGTLVTVSS (SEQ ID NO: 423)

BMS3h-56-276
EVQLLESGGGLVQPGGSLRLSCAASGFTFRDYEMWWVRQAPGKGLERVSAINPWGSLTYYADSVKGRFTISRDNSKNTL
YLQMNSLRAEDTAVYYCAKLPFFFQEWGQGTLVTVSS (SEQ ID NO: 424)

BMS3h-56-277
EVQLLESGGGLVQPGGSLRLSCAASGFTFRDYEMWWVRQAPGKGLERVSAINPWGSLTYYADSVKGRFTISRDNSKNTL
YLQMNSLRAEDTAVYYCAKLPFFFHEWGQGTLVTVSS (SEQ ID NO: 425)

BMS3h-56-278
EVQLLESGGGLVQPGGSLRLSCAASGFTFRDYEMWWVRQAPGKGLERVSAINPWGGFTYYADSVKGRFTISRDNSKNTL
YLQMNSLRAEDTAVYYCAKLPFYFQEWGQGTLVTVSS (SEQ ID NO: 426)

BMS3h-56-279
EVQLLESGGGLVQPGGSLRLSCAASGFTFRDYEMWWVRQAPGKGLERVSAINPWGGFTYYADSVKGRFTISRDNSKNTL
YLQMNSLRAEDTAVYHCAKLPMFFEDWGQGTLVTVSN (SEQ ID NO: 427)

BMS3h-56-280
EVQLLESGGGLVQPGGSLRLSCAASGFTFRDYEMWWVRQAPGKGLERVSAINPWGGFTYYADSVKGRFTISRDNSKNTL
YLQMNSLRAEDTAVYYCAKLPFYFHEWGQGTLVTVSS (SEQ ID NO: 428)

BMS3h-56-281
EVQLLESGGGLVQPGGSLRLSCAASGFTFRDYEMWWVRQAPGKGLERVSAINPWGGFTYYADSVKGRFTISRDNSKNTL
YLQMNSLRAEDTAVYYCAKLPFFFQEWGQGTLVTVSS (SEQ ID NO: 429)

BMS3h-56-282
EVQLLESGGGLVQPGGSLRLSCAASGFTFRDYEMWWVRQAPGKGLERVSAINPWGGFTYYADSVKGRFTISRDNSKNTL
YLQMNSLRAEDTAVYYCAKLPFFFHEWGQGTLVTVSS (SEQ ID NO: 430)

BMS3h-56-283
EVQLLESGGGLVQPGGSLRLSCAASGFTFRDYEMWWVRQAPGKGLERVSAINPWGGLTYYADSVKGRFTISRDNSKNTL
YLQMNSLRAEDTAVYYCAKLPFYFQEWGQGTLVTVSS (SEQ ID NO: 431)

BMS3h-56-284
EVQLLESGGGLVQPGGSLRLSCAASGFTFRDYEMWWVRQAPGKGLERVSAINPWGGLTYYADSVKGRFTISRDNSKNTL
YLQMNSLRAEDTAVYHCAKLPMFFEDWGQGTLVTVSN (SEQ ID NO: 432)

BMS3h-56-285
EVQLLESGGGLVQPGGSLRLSCAASGFTFRDYEMWWVRQAPGKGLERVSAINPWGGLTYYADSVKGRFTISRDNSKNTL
YLQMNSLRAEDTAVYYCAKLPFYFHEWGQGTLVTVSS (SEQ ID NO: 433)

BMS3h-56-286
EVQLLESGGGLVQPGGSLRLSCAASGFTFRDYEMWWVRQAPGKGLERVSAINPWGGLTYYADSVKGRFTISRDNSKNTL
YLQMNSLRAEDTAVYYCAKLPFFFQEWGQGTLVTVSS (SEQ ID NO: 434)

BMS3h-56-287
EVQLLESGGGLVQPGGSLRLSCAASGFTFRDYEMWWVRQAPGKGLERVSAINPWGGLTYYADSVKGRFTISRDNSKNTL
YLQMNSLRAEDTAVYYCAKLPFFFHEWGQGTLVTVSS (SEQ ID NO: 435)

BMS3h-56-288
EVQLLESGGGLVQPGGSLRLSCAASGFTFRDYEMWWVRQAPGKGLERVSAINPQGTRTYYADSVKGRFTISRDNSKNTL
YLQMNSLRAEDTAVYHCAKLPMFFEDWGQGTLVTVSS (SEQ ID NO: 436)

BMS3h-106-1
EVQLLETGGGLVQPGGSLRLSCAASGFTFSTYHMQWVRRAPGKGLEWVSMIDADGLGTYYADPVKGRFTISRDNSKNTL
YLQMNSLRAKDTAVYYCARPGPQFGQFDYLGQGTLVTVSS (SEQ ID NO: 437)

BMS3h-106-2
EVQLFESGGGLVQTGGSLRLSCAASGFTFSTYHMQWVRQAPGKGLEWVSMIDADGLGKYYADPVKGRFTISRDNSKNTL
YLQMNSLRAEDTAVYYCVKPGPQFGQYDYWGQGTLVTVSS (SEQ ID NO: 438)

BMS3h-107-1
EVQLLESGGGLVQPGGSLRLSCSASGFTFSGYDMQWVRQAPGKGLEWVSTISASGVYTYYADSVKGRFTISRDNSKNTL
YLQMNSLRAEDTAVYYCAKYPNRFALNSFDYRGRGTLVTVSS (SEQ ID NO: 439)

TABLE 3-continued

Anti-Human CD40 Variable Domain Amino Acid Sequences

BMS3h-107-2
EVQLLESGGGLVQPGGSLRLSCAASGFTFSGYDMQWVRQAPGRGLEWVSTISASGVYTYYTDSVKGRFTTSRDNSKNTL
YLQMNSLRAEDTAVYYCTKYPNRFARNNFDYWGQGTLVTVSS (SEQ ID NO: 440)

BMS3h-131-1
DILMTQSPSSLSASVGDRVTITCRANSSILWALAWYQQKPGEAPKLLIESSSGLQSGVPSRFSGSGSGTDFTLTISSLQ
PEDFATYYCVQNAVWPGTFSQGTKVEIKR (SEQ ID NO: 441)

BMS3h-131-2
DIQMTQSPSSLSASVGDRVTITCRADSSILWALAWYQQKPGKAPKLLIESSSGLQSGVPSRFSGSGSGTDFTLTISSLQ
PEDFATYYCVQNAVWPGTFGQGTKVEIKR (SEQ ID NO: 442)

BMS3h-131-3
DIQMTVSPSSLSASVGDRVTITCRADSSILWALAWYQQKPGKAPKLLIESSSGLQSGVPSRFSGSGSGTDFTLTISSLQ
PEDFATYYCVQNAVWPGTFGQGTKVEIKR (SEQ ID NO: 443)

BMS3h-131-4
DIQMTQSPSSLSASVGDRVTITCRANSSILWALAWYQQKPGKAPKLLIESSSGLQSGVPSRFSGSGSGTDFTLTISSLQ
PEDFATYYCVQNAVWPGTFDQGTKVEIKR (SEQ ID NO: 444)

BMS3h-131-5
DIQMTQSPSSLSASVGDRVTITCRANSSILWALAWYQQKPGKAPKLLIESSTGLQSGVPSRFSGSGSGTDFTLTISSLQ
PEDFATYYCVQNAVWPGTFGQGTKVEIKR (SEQ ID NO: 445)

BMS3h-131-6
DIQMTVSPSSLSASVGDRVTITCRANSSILWALAWYQQKPGKAPKLLIESSSGLQSGVPSRFSGSGSGTDFTLTISSLQ
PEDFATYYCVQNAVWPGTFGQGTKVEIKR (SEQ ID NO: 446)

BMS3h-131-7
DIQMTQSPSSLSASVGDRVTITCRADSSILWALAWYQQKPGKAPKLLIESSSGLQSGVPSRFSGSGSGTDFTLTISSLQ
PEDFATYYCVQNAVWPGTFDQGTKVEIKR (SEQ ID NO: 447)

BMS3h-131-8
DIQMTQSPSSLSASVGDRVTITCRANSSILWALAWYQQKPGKAPELLIESSSGLQSGVPSRFSGSGSGTDFTLTISSLQ
PEDFATYYCVQNAVWPGTFGQGTKVEIKR (SEQ ID NO: 448)

BMS3h-131-9
DIQMTQSPSSLSASVGDRVTITCRANSSILWALAWYQQKPGKAPKLLIESSSGLQSGVPSRFSGSGSGTDFTLTISSLQ
PEDFATYYCVQNAVWPGTFGQGTKVENKR (SEQ ID NO: 449)

BMS3h-131-10
DIQMTQSPSSLSASVGDRVTITCRANSSILWALAWYQQKPGKAPKLLIESSSGLQSGVPSRFSGSGSGTDFTLTISSLQ
PEDFATYYCVQNAVWPGTFGQGTKVEIKR (SEQ ID NO: 450)

BMS3h-131-11
DIQMTQSPSSLSASVGDRVTITCRANSSILWALAWYQQKPGKAPKLLIESSSGLQSGIPSRFSGSGSGTDFTLTISSLQ
PEDFATYYCVQNAVWPGTFGQGTKVEIKR (SEQ ID NO: 451)

BMS3h-131-12
DIQMTQSPSSLSASVGDRVTITCRANSSILWALAWYQQKPGKAPKLLIESSSGLQSGVPSRFSGSGSGTDFTLTISSLQ
PEDFATYYCVQNAVWPGTFGQGTKVEIKR (SEQ ID NO: 452)

BMS3h-131-13
DILLTQSPSSLSASVGDRVTITCRANSSILWALAWYQQKPGKAPKLLIESSSGLQSGVPSRFSGSGSGTDFTLTISSLQ
PEDFATYYCVQNAVWPGTFGQGTKVEIKR (SEQ ID NO: 453)

BMS3h-131-14
DIQMTQSPSSLSASVGDRVTITCRANSSILWALAWYQQKPGKAPKLLIESSSGLQSGVPSRFSGSGTGTDFTLTISGLQ
PEDFATYYCVQNAVWPGTFDQGTKVEIKR (SEQ ID NO: 454)

BMS3h-131-15
DIQMTQSPSSLSASVGDRVTIPCRANSSILWALAWYQQKPGKAPKLLIESSSGLQSGVPSRFSGSASGTDFTLTISSLQ
PEDFATYYCVQNAVWPGTFGQGTKVEIKR (SEQ ID NO: 455)

BMS3h-193-1
DIQMAQSPSSLSASVGDRVTITCRASQTIERRLNWYQQKPGKAPKLLIYLASRLQSGVPSRFSGSGSGTDFTLTISSLQ
PEDFATYYCHQYASPPLTLGQGTKVEIKR (SEQ ID NO: 456)

BMS3h-193-2
DIQMTQSPSSLSASVGDSVTITCRASQTIERRLNWYQQKPGEAPKLLIYLASRLQSGVPSRFSGSGSGTDFTLTISSLQ
PEDFATYYCHQYASPPLTFGQGTNVEIKR (SEQ ID NO: 457)

BMS3h-193-3
DIQMTQSPSSLSASVGDRVTITCRASQTIERRLNWYQQKPGKAPKLLIYLASRLQSGVPSRFSGSGSGTDFTLTISSLQ
PEDFAAYYCHQYESPPLTFGQGTKVEIKR (SEQ ID NO: 458)

TABLE 3-continued

Anti-Human CD40 Variable Domain Amino Acid Sequences

BMS3h-193-4
DIQMTQSPSSLSASVGDRVTITCRASRTIERRLNWYQQKPGKAPKLLIYLASRLQSGVPSRFSGSGSGTDFTLTISSLQ
PEDFATYYCHQYESPPLTFGQGTKVEIKR (SEQ ID NO: 459)

BMS3h-193-5
DIQMTQSPSSLSASVGERVTITCRASQTIERRLNWYQQKPGKAPKLLIYLASRLQSGVPSRFSGSGSGTDFTLTISNLQ
PEDSATYYCHQYASPPLTLGQGTKVEIKR (SEQ ID NO: 460)

BMS3h-193-6
DIQMTQSPSSLSASVGDRVTITCRASQTIERRLNWYQQKPGKAPKLLIYLASRLQSGVPSRFSGSGSGTDFTLTISSLQ
PEDFATYYCHQYASPPLTLGQGTKVEIKR (SEQ ID NO: 461)

BMS3h-193-7
DIQITQSPSSLSASVGDRVTITCRASQTIERRLNWYQQKPGKDPKLLIYLASRLQSGVPSRFSGSGSGTDFTLTISSLQ
PEDFATYYCHQYESPPLTFGQGTKVEIKR (SEQ ID NO: 462)

BMS3h-193-8
DIQMTQSPSSLSASVGDRVTITCRASQTIERRLNWYQQKPGEAPKLLIYLASRLQSGVPSRFSGSGSGTDFTLTISSLQ
PEDFATYYCHQYESPPLTFGQGTKVEIKW (SEQ ID NO: 463)

BMS3h-193-9
DIQLTQSPSSLSASVGDRVTITCRASQTIERRLNWYQQKPGKAPKLLIYLASRLQSGVPSRFSGSGSGTEFTLTISSLQ
PEDFATYYCHQYESPPLTFGQGTKVEIKR (SEQ ID NO: 464)

BMS3h-193-10
DIQMSQSPSTLSASVGDRVTITCRASQTIERRLNWYQQKPGKAPKLLIYLASRLQSGVPSRFSGSGSGTDFTLTISSLQ
PEDFATYYCHQYESPPLMFGQGTKVEIKR (SEQ ID NO: 465)

BMS3h-193-11
DIQMTQSPSSLSASVGDRVTITCRASQTIERRLNWYQQKPGKDPKLLIYLASRLQSGVPSRFSGSGSGTDFTLTISSLQ
PEDFATYYCHQYESPPLTFGQGTKVEIKR (SEQ ID NO: 466)

BMS3h-193-12
DIQMTQSPSSLSASVGDRVTITCRASQTIERRLNWYQQKPGKAPKLLIYLASRLQSGVPSRFSGSGSGTDFTLTISSLQ
PEDFATYYCHQYESPPLTFGQGTKVEIKR (SEQ ID NO: 467)

BMS3h-193-13
DIQMTQSPSSLFASVGDRVTITCRASQTIERRLNWYQQKPGKAPKLLIYLASRLQSGVPSRFSGSGSGTDFTLTISSLQ
PEDFATYYCHQYESPPLTFGQGTKVEIKR (SEQ ID NO: 468)

BMS3h-193-14
DIQMTQYPSSLSASVGDRVTITCRASQSIERRLNWYQQKPGEAPKLLIYLASRLQSGVPSRFSGSGSGTDFTLTISSLQ
PEDFATYYCHQYESPPLTFGQGTKVEIKR (SEQ ID NO: 469)

BMS3h-193-15
DIQMTQSPSSLSASVGDRVTITCRASRTIERRLNWYQQKPGKAPKLLIYLASRLQSGVPSRFSGSGSGTDFTLTISSLQ
PEDFATYYCHPYESPPLTFGQGTKVEIKR (SEQ ID NO: 470)

BMS3h-193-16
DIQMTQSPSSLSASVGDRVTITCRASQAIERRLNWYQQKPGKAPKLLIYLASRLQSGVPSRFSGSGSGTDFTLTISSLQ
PEDFATYYCHQYASPPLTLGQGTKVEIKR (SEQ ID NO: 471)

BMS3h-193-17
NIQMTQSPSSLSASVGDRVTITCRASQAIERRLNWYQQKPGKAPKLLIYLASRLQSGVPSRFSGSGSGTDFTLTISSLQ
PEDFATYYCHQYESPPLTFGQGTKVEIKR (SEQ ID NO: 472)

BMS3h-193-18
DIQMTQSPSSLSASVGDRVTITCRASQTIGRRLNWYQQKPGKAPKLLIYLASRLQSGVPSRFSGSGSGSDFTLTISSLQ
PEDFATYYCHQYESPPLTFGQGTKVEIKR (SEQ ID NO: 473)

BMS3h-193-19
DIQMTQSPSSLSASVGDRVTITCRASQTIERRLNWYQQKPGKAPKLLIYLASRLQSGVPSRFSGSGSGTEFTLTISSLQ
PEDFATYYCHQYESPPLTFGQGTKVEIKR (SEQ ID NO: 474)

BMS3h-193-20
DIQMTQTPSSLSASVGDRVTITCRASQTIERRLNWYQQKPGEAPKLLIYLASRLQSGVPSRFSGSGSGTDFTLTISSLQ
PEDFATYYCHQYESPPLTFGQGTKVKIKR (SEQ ID NO: 475)

BMS3h-193-21
DIQMTQSPSSLSASVGDSVTITCRASQTIERRLNWYQQKPGKAPKLLIYLASRLQSGVPSRFSGSGSGTDFTLTISSLQ
PEDFATYYCHQYESPPLTFGQGTKVEIKR (SEQ ID NO: 476)

BMS3h-193-22
HIQMTQSPSSLSASVGDRVTITCRASQTIERRLNWYQQKPGKAPKLLIYLASRLQSGVPSRFSGSGSGTDFTLTISSLQ
PEDFATYYCHQYESPPLTFGQGTKVEIKR (SEQ ID NO: 477)

TABLE 3-continued

Anti-Human CD40 Variable Domain Amino Acid Sequences

BMS3h-193-23
DVQMTQSPSSLSASVGDRVTITCRASQTIERRLNWYQQKPGEAPKLLIYLTSRLQSGVPSRFSGSGSGTDFTLTISSLQ
PEDFATYYCHQYASPPLTFGQGTKVEIKR (SEQ ID NO: 478)

BMS3h-193-24
DIQMTQSPSSLSASVGDRVTITCRASQTIERRLNWYQQKPGKAPKLLIYLASRLQSGVPSRFSGSGSGTDFTLTISSLQ
PEDFATYYCHQYESPPLTFGQGTKWIKR (SEQ ID NO: 479)

BMS3h-193-25
DIQMTQSPSSLSASVGDRVTITCRASQTIERRLNWYQQKPGKAPRLLIYLATRLQSGVPSRFSGSGSGTDFTLTISSLQ
PEDFATYYCHQYESPPLTFGQGTKVEIKR (SEQ ID NO: 480)

BMS3h-193-26
DIQMTQSPSSLSASVGDRVTITCRASQPIERRLNWYQQKPGKAPKLLIYLASRLQSGVPSRFSGSGSGTDFTLTISSLQ
PEDFATYYCHQYESPPLTFGQGTKVEIKR (SEQ ID NO: 481)

BMS3h-193-27
DIQMTQSPSSLSASVGDRVTITCRASQTIGRRLNWYQQKPGKAPKLLIYLASRLQSGVPSRFSGSGSGTDFTLTISSLQ
PEDFATYYCHQYESPPLTFGQGTKVEIKR (SEQ ID NO: 482)

BMS3h-193-28
DIQMTQSPSSLSASVGDRVTITCRASQSIERRLNWYQQKPGKAPKLLIYLASRLQSGVPSRFSGSGSGTDFTLTISSLQ
PEDFATYYCHQYESPPLTFGQGTKVEIIR (SEQ ID NO: 483)

BMS3h-193-29
DIQMTQSPSSLSASVGDRVTITCRASQTIERRLNWYQQKPGKAPKLLIYLATRLQSGVPSRFSGSGSGTDFTLTISSLQ
PEDFATYYCHQYESPPLTFGQGTKVEIKR (SEQ ID NO: 484)

BMS3h-193-30
DIQMTQSPSSLSASVGDRVTITCRASQSIERRLNWYQQKPGKAPKLLIYLASRLQSGVPSRFSGSGSGTDFTLTISSLQ
PEDFATYYCHQYESPPLTFGQGTKVEIKR (SEQ ID NO: 485)

BMS3h-193-2501
DIQMTQSPSSLSASVGDRVTITCRASQTIERRLNWYQQKPGKAPRLLIYLATRLQSGVPSRFSGSGSGTDFTLTISSLQ
PEDFATYYCHQFEHPPLTFGQGTKVEIKR (SEQ ID NO: 486)

BMS3h-193-2502
DIQMTQSPSSLSASVGDRVTITCRASFPIDRRLNWYQQKPGKAPRLLIYLATRLQSGVPSRFSGSGSGTDFTLTISSLQ
PEDFATYYCHQYESPPLTFGQGTKVEIKR (SEQ ID NO: 487)

BMS3h-193-2503
DIQMTQSPSSLSASVGDRVTITCRASSTIGRRLNWYQQKPGKAPRLLIYLATRLQSGVPSRFSGSGSGTDFTLTISSLQ
PEDFATYYCHQYESPPLTFGQGTKVEIKR (SEQ ID NO: 488)

BMS3h-193-2504
DIQMTQSPSSLSASVGDRVTITCRASSQIGRRLNWYQQKPGKAPRLLIYLATRLQSGVPSRFSGSGSGTDFTLTISSLQ
PEDFATYYCHQYESPPLTFGQGTKVEIKR (SEQ ID NO: 489)

BMS3h-193-2505
DIQMTQSPSSLSASVGDRVTITCRASERIGRRLNWYQQKPGKAPRLLIYLATRLQSGVPSRFSGSGSGTDFTLTISSLQ
PEDFATYYCHQYESPPLTFGQGTKVEIKR (SEQ ID NO: 490)

BMS3h-193-2506
DIQMTQSPSSLSASVGDRVTITCRASQQIGRRLNWYQQKPGKAPRLLIYLATRLQSGVPSRFSGSGSGTDFTLTISSLQ
PEDFATYYCHQYESPPLTFGQGTKVEIKR (SEQ ID NO: 491)

BMS3h-193-2507
DIQMTQSPSSLSASVGDRVTITCRASQPIARRLNWYQQKPGKAPRLLIYLATRLQSGVPSRFSGSGSGTDFTLTISSLQ
PEDFATYYCHQYESPPLTFGQGTKVEIKR (SEQ ID NO: 492)

BMS3h-193-2508
DIQMTQSPSSLSASVGDRVTITCRASGNIGRRLNWYQQKPGKAPRLLIYLATRLQSGVPSRFSGSGSGTDFTLTISSLQ
PEDFATYYCHQYESPPLTFGQGTKVEIKR (SEQ ID NO: 493)

BMS3h-193-2509
DIQMTQSPSSLSASVGDRVTITCRASRNIDRRLNWYQQKPGKAPRLLIYLATRLQSGVPSRFSGSGSGTDFTLTISSLQ
PEDFATYYCHQYESPPLTFGQGTKVEIKR (SEQ ID NO: 494)

BMS3h-193-2510
DIQMTQSPSSLSASVGDRVTITCRASQSIGRRLNWYQQKPGKAPRLLIYLATRLQSGVPSRFSGSGSGTDFTLTISSLQ
PEDFATYYCHQYESPPLTFGQGTKVEIKR (SEQ ID NO: 495)

BMS3h-193-2511
DIQMTQSPSSLSASVGDRVTITCRASQNIGTRLNWYQQKPGKAPRLLIYLATRLQSGVPSRFSGSGSGTDFTLTISSLQ
PEDFATYYCHQYESPPLTFGQGTKVEIKR (SEQ ID NO: 496)

TABLE 3-continued

Anti-Human CD40 Variable Domain Amino Acid Sequences

BMS3h-193-2512
DIQMTQSPSSLSASVGDRVTITCRASEVIGRRLNWYQQKPGKAPRLLIYLATRLQSGVPSRFSGSGSGTDFTLTISSLQ
PEDFATYYCHQYESPPLTFGQGTKVEIKR (SEQ ID NO: 497)

BMS3h-193-2513
DIQMTQSPSSLSASVGDRVTITCRASEAIGRRLNWYQQKPGKAPRLLIYLATRLQSGVPSRFSGSGSGTDFTLTISSLQ
PEDFATYYCHQYESPPLTFGQGTKVEIKR (SEQ ID NO: 498)

BMS3h-193-2514
DIQMTQSPSSLSASVGDRVTITCRASTSIARRLNWYQQKPGKAPRLLIYLATRLQSGVPSRFSGSGSGTDFTLTISSLQ
PEDFATYYCHQYESPPLTFGQGTKVEIKR (SEQ ID NO: 499)

BMS3h-193-2515
DIQMTQSPSSLSASVGDRVTITCRASLNIGRRLNWYQQKPGKAPRLLIYLATRLQSGVPSRFSGSGSGTDFTLTISSLQ
PEDFATYYCHQYESPPLTFGQGTKVEIKR (SEQ ID NO: 500)

BMS3h-193-2516
DIQMTQSPSSLSASVGDRVTITCRASQTIERRLNWYQQKPGKAPRLLIYLSSKLQSGVPSRFSGSGSGTDFTLTISSLQ
PEDFATYYCHQYESPPLTFGQGTKVEIKR (SEQ ID NO: 501)

BMS3h-198-1
EVQLLESGGGLVQPGGSLRLSCAASGSTIAGYEMWWVRQAPGKGLERVSAISGSGGSTYYADSVKGRFTISRDDSKNTL
YLQMNSLRAEDTAVYYCARDPYSFDYWGQGTLVTVSS (SEQ ID NO: 502)

BMS3h-198-2
EVQPLESGGGLVQPGGSLRLSCAASGFTFAGYEMWWVRQAPGKGLERISAISGSGGSTYYADSVKGRFTISRDDSKNTL
YLQMNSLRAEDTAVYYCARDPYSFDYWGQGTLVTVSS (SEQ ID NO: 503)

BMS3h-198-3
EVQLLESGGGSVQPGGSLRLSCAATGSTFAGYEMWWVRQAPGKGLERVSAISGSGGSTYYADSVKGRFTISRDDSKNTL
YLQMNSLRAEDTAVYYCARDPYSYDYWGQGTLVSVSS (SEQ ID NO: 504)

BMS3h-198-4
EVQLLESGGGLVQPGGSLRLSCAASGLTFAGYEMWWVRQAPGKGLERVSAISGSGGSTYYADSVKGRFTISRDDSKNTL
YLQMNSLRAEDTAVYHCARDPYSFDYWGQGTLVTVSS (SEQ ID NO: 505)

BMS3h-198-5
EVQLLESGGGLVQPGGSLRLSCAASGFTFAGYEMWWVRQAPGKGLERVSAISGSGGSTYYADSVKGRFTISRDDSKNTL
YLQMNSLRAEDTAVYHCAKEPYSYDYWGQGTLVTVSS (SEQ ID NO: 506)

BMS3h-198-6
EVQLLESGGGLVQPGGSLRLSCAASGSTFAGYEMWWVRQAPGKGLERVSAISGSGGSTYYADSVKGRFTISRDDSKNTL
YLQMNSLRPEDTAVYYCVKDPYSFDYWGQGTLVTVSS (SEQ ID NO: 507)

BMS3h-198-7
EVQLLESGGGLVQPGGSLRLSCAASGSTIAGYEMWWVRQAPGKGLERVSAISGSGGSTYYADSVKGRFTISRDDSKNTL
YLQMNSLRAEDTAVYYCARDPYSFDYWGQGTPVTVSS (SEQ ID NO: 508)

BMS3h-198-8
EVQLMESGGGLVQPGGSLRLSCAASGSTFAGYEMWWVRQAPGKGLERVSAISGSGRSTYYADSVKGRFTISRDDSKNTL
YLQMNSLRAEDTAVYYCAKDPYSFDYWGQGTLVTVSS (SEQ ID NO: 509)

BMS3h-198-9
EVQLLESGGGLVQPGGSLRLSCAASGFTFAGYEMWWVRQAPGKGLERVSAISGSGGSTYYADSVKGRFTISRDDSKNTL
YLQMNSLRAEDTAVYYCAKEPYSFDYWGQGTLVTVSS (SEQ ID NO: 510)

BMS3h-198-10
EVQLLESGGGLVQPGGSLRLSCAASGSTIAGYEMWWVRQAPGKGLERVSAISGSGGSTYYADSVKGRFTISRDDSKNTL
YLQMNSLRAEDTAVYYCAKDPYSFDYWGQGTLVTVSS (SEQ ID NO: 511)

BMS3h-198-11
EVQLLESGGGLVQPGGSLRLSCAASGFTFAGYEMWWVRQAPGKGLERVSAISGSGGSTYYADSVKGRFTISRDDSKNTL
YLQMNSLRAEDTAVYYCARDPYSFDYWGQGTLVSVSS (SEQ ID NO: 512)

BMS3h-198-12
EVQLLESGGGLVQPGGSLRLSCAASGFTIAGYEMWWVRQAPGKGLERVSAISGSGGSTYYADSVKGRFTISRDDSKNTL
YLQMNSLRAEDTAVYYCAKDPYSFDYWGQGTLVTVSS (SEQ ID NO: 513)

BMS3h-198-13
EVQLLESGGGLVQPGGSLRLSCAASGFTFAGYEMWWVRQAPGKGLERVSAISGSGGSTYYADSVKGRFTITRDDSKNTL
YLQMNSLRAEDTAVYYCAKEPYSFDYWGQGTLVTVSS (SEQ ID NO: 514)

BMS3h-198-14
EVQLLESGGGLVQPGGSLRLSCAASGFTFAGYEMWWFRQAPGKGLERVSAISGSGGSTYYADSVKGRFTISRDDTKNTL
YLQMNSLRAEDTAVYYCAKDPYSFDYWRQGTLVTVSS (SEQ ID NO: 515)

TABLE 3-continued

Anti-Human CD40 Variable Domain Amino Acid Sequences

BMS3h-198-15
EVQLLESGGGLVQPGGSLRLSCAASGSTFAGYEVWWVRQAPGKGLERVSAISGSGGSTYYADSVKGRFTISRDDSKNTL
YLQMNSLRAEDTAVYYCARDPYSFDYWGQGTLVTVSS (SEQ ID NO: 516)

BMS3h-198-16
EVQLLESGGGLVQPGGSLRLSCAASGSTFAGYEMWWVRQAPGKGLERISAISGSGGSTYYADSVKGRFTISRDDSKNTL
YLKMNSLRAEDTAVYYCAKDPYSFDYWGQGTLVTVSS (SEQ ID NO: 517)

BMS3h-198-17
EVQLLESGGGLVQPGGSLRLSCAASGFTFAGYEMWWVRQAPGKGLERVSAISGSGGSTYYADSVKGRFTISRDDSKNTL
YLQMNSLRAEDTAVYYCARDPYSFDYWGQGTLVTVSS (SEQ ID NO: 518)

BMS3h-198-18
EVQLLESGGGLVQPGGSLRLSCAASGLTFAGYEMWWVRRAPGKGLERVAAISGSGGSTYYADSVKGRFTISRDDSKNTL
YLQMNSLRAEDTAVYYCARDPYSFDYWGQGTLVTVSS (SEQ ID NO: 519)

BMS3h-198-19
EVQLLESGGGLVQPGGSLRLSCAASGFTFAGYELWWVRQAPGKGLERVSAISGSGGSTYYADSVKGRFTISRDDSKNTL
YLQMNSLRAEDTAVYYCARDPYSFDYRGQGTLVTVSS (SEQ ID NO: 520)

BMS3h-198-20
EVQLLESGGGLVQPGGSLRLSCAAPGFTLAGYEMWWVRQAPGKGLERVSAISGSGGSTYYADSVKGRFTISRDDSKNTL
YLQMNSLRAEDTAVYYCAKEPYSFDYWGQGTLVTVSS (SEQ ID NO: 521)

BMS3h-198-21
EVQLLESGGGLVQPGGSLRLSCAASGLTFAGYEMWWVRRAPGKGLERVSAISGSGGSTYYADSVKGRFTTSRDDSKNTL
YLQMNSLRAEDTAVYYCARDPYSFDYWGRGTLVTVSS (SEQ ID NO: 522)

BMS3h-198-22
EVQLLESGGGLVQPGGSLRLSCAASGFTFAGYEMWWVRQAPGKGLERVSAISGSGGSTYYADSVKGRFTISRDDSKNTL
YLQMNSLRAEDTAVYYCAKEPYSYDYWGHGTLVTVSS (SEQ ID NO: 523)

BMS3h-198-23
EVQPLESGGGLVQPGGSLRLSCAASGFTFAGYEMWWVRQAPGKGLERVSAISGSGGNTYYADSVKGRFTISRDDSKNTL
YLQMNSLRAEDTGVYYCARDPYSFDYWGQGTLVTVSS (SEQ ID NO: 524)

BMS3h-198-24
EVQLLESGGGLVQPGGSLRLSCAASGFTFAGYEMWWVRQAPGKGLERVSAISGSGGSTYYADSVKGRFTISRDDSKNTL
YLQMNSLRAEDTAVYYCAKEPYSFDSWGQGTLVTVSS (SEQ ID NO: 525)

BMS3h-198-25
EAQLLESGGGLVQPGGSLRLSCAASGLTFAGYEMWWVRQAPGKGLERVSAISGSGGSTYYADSVKGRFTISRDDSKNTL
YLQMNSLRAEDTAVYYCARDPYSFDYWGQGTLVTVSS (SEQ ID NO: 526)

BMS3h-198-26
EVQLLESGGGLVQPGGSLRLSCAASGSTFAGYEMWWVRQAPGKGLERVSAISGSGGSTYYADSVKGRFSISRDDSKNTL
YLQMNSLRAEDTAVYYCAKEPYSFDHWGQGTLVTVSS (SEQ ID NO: 527)

BMS3h-198-27
EVQLLESGGGLVQPGGSLRLSCAASGSTFAGYEMWWVRRAPGKGLERVSAISGSGGSTYYADSVKGRFTISRDDSKNTL
YLQMNSLRAEDTAVYYCARDPYSFDYWGQGTLVTVSS (SEQ ID NO: 528)

BMS3h-198-28
EVQLLESGGGLVQPGGSLRLSCAASGFTFAGYEMWWFRQAPGKGLERVSAISGSGGSTYYADSVKGRFTISRDDSKNTL
YLQMNSLRAEDTAVYYCAKDPYSFDNWGQGTLVTVSS (SEQ ID NO: 529)

BMS3h-198-29
EVQLLESGGGLVEPGGSLRLSCAASGFTFAGYEMWWVRQAPGKGLERVSAISGSGGSTYYADSVKGRFTISRDDSKNTL
YLQMNSLRAEDTAVYYCAKEPYSFDHRGQGTLVTVSS (SEQ ID NO: 530)

BMS3h-198-30
EVQLLESGGGLVQPGGSLRLSCAASGYTFAGYEMWWVRQAPGKGLERVSAISGSGGSTYYADSVKGRFTISRDDSKNTL
YLQMNSLRAEDTAVYYCAKEPYSFDHRGQGTLVTVSS (SEQ ID NO: 531)

BMS3h-198-31
EVQLLESGGGLVQPGGSLRLSCAASGFTFAGYEMWWVRQAPGKGLERVSAISGSGGSTYYADSVKGRFTISRDNSKNTL
YLQMNSLRAEDTAVYHCAKEPYSYDYWGQGTLVTVSS (SEQ ID NO: 532)

BMS3h-198-32
EVQLLESGGGLVQPGGSLRLSCAASGFTFAGYEMWWFRQAPGKGLERVSAISGSGGSTWADSVKGRFTISRDNSKNTL
YLQMNSLRAEDTAVYYCAKDPYSFDNWGQGTLVTVSS (SEQ ID NO: 533)

BMS3h-198-33
EVQLLESGGGLVQPGGSLRLSCAASGFTFAGYEMWWVRQAPGKGLERVSAISGSGGSTYYADSVKGRFTISRDDSKNTL
YLQMNSLRAEDTAVYYCAKEPYSYDYWGQGTLVTVSS (SEQ ID NO: 534)

TABLE 3-continued

Anti-Human CD40 Variable Domain Amino Acid Sequences

BMS3h-198-34
EVQLLESGGGLVQPGGSLRLSCAASGFTFAGYEMWWVRQAPGKGLERVSAISGSGGSTYYADSVKGRFTISRDDSKNTL
YLQMNSLRAEDTAVYYCAKDPYSFDNWGQGTLVTVSS (SEQ ID NO: 535)

BMS3h-198-35
EVQLLESGGGLVQPGGSLRLSCAASGFTFAGYEMWWVRQAPGKGLEWVSAISGSGGSTYYADSVKGRFTISRDDSKNTL
YLQMNSLRAEDTAVYHCAKEPYSYDYWGQGTLVTVSS (SEQ ID NO: 536)

BMS3h-198-36
EVQLLESGGGLVQPGGSLRLSCAASGFTFAGYEMWWFRQAPGKGLEWVSAISGSGGSTYYADSVKGRFTISRDDSKNTL
YLQMNSLRAEDTAVYYCAKDPYSFDNWGQGTLVTVSS (SEQ ID NO: 537)

BMS3h-198-37
EVQLLESGGGLVQPGGSLRLSCAASGFTFAGYELWWVRQAPGKGLERVSAISGSGGSTYYADSVKGRFTISRDDSKNTL
YLQMNSLRAEDTAVYYCAKDPYSFDYRGQGTLVTVSS (SEQ ID NO: 538)

BMS3h-198-38
EVQLLESGGGLVQPGGSLRLSCAASGFTFAGYELWWVRQAPGKGLERVSAISGSGGSTYYADSVKGRFTISRDDSKNTL
YLQMNSLRAEDTAVYYCARDPYSFDYWGQGTLVTVSS (SEQ ID NO: 539)

BMS3h-202-1
EVQLLESGGGLVQPGGSLRLSCAASGFTFPTAEMLWVRKAPGKGLEWVSSISASGGSTYYADSVKGRFTISRDNSKNTL
YLQMNSLRAEDTAVYYCAKEPVSYVATFDYWGQGTLVTVSS (SEQ ID NO: 540)

BMS3h-202-2
EVQLLVSGGGLVQPGGSLRLSCAASGFTFPTAEMLWVRQAPGKGPEWVSSISASGGSTYYADSVKGRFTISRDNSKNTL
YLQMNSLRAEDTAVYYCAKEPVSYVATFDYWGQGTLVTVSS (SEQ ID NO: 541)

BMS3h-202-3
EVQLLESGGGLVQPGGSLRLSCAASGFTFPTAEMVWVRKAPGMGLEWVSSISASGGYTYYADSVKGRFTISRDNSKNML
YLQMNSLRAEDTAVYYCAKEPVSYVATFDYWGQGALVTVTS (SEQ ID NO: 542)

BMS3h-202-4
EVQLLVSGGGLVQPGGSLRLSCAASGFTFPTAEMVWVRQAPGKGLEWVSSISASGGSTYYADSVKGRFSISRDDSKNTL
YLQMNSLRAEDTAVYYCAKEPVSYVATFDYWGHGALVTVSS (SEQ ID NO: 543)

BMS3h-202-5
EVQLLESGGGLVQPGGSLRLSCAASGFTFPTAEMLWVRQAPGKGLEWVSSISASGGSTYYADSVKGRFTISRDNSKNTL
YLQMNSLRAEDTAVYYCAKEPVSYVATFDYWGQGTLVTVSS (SEQ ID NO: 544)

BMS3h-202-6
EAQLLESGGGLVQPGGSLRLSCAASGFTFPTAEMVWVRQAPGKGLEWISSISASGGSTYYADSVKGRFTISRDNSKNTL
YLQLNSLRAEDTAVYYCAKEPVSYVATFDYWGRGTLVTVSS (SEQ ID NO: 545)

BMS3h-202-7
EVQLLESGGGLVQPGGSLRLSCAASGFTFPTAEMLWVRQAPGKGLEWVSSISASGGSTYYADSVKGRFTISRDNSKSTL
YLQMNSLRAEDTAVYYCAKEPVSYVATFDYWGPGALVTVSS (SEQ ID NO: 546)

BMS3h-202-8
EVQLLESGGGLVQPGGSLRLSCAASGFTFPTAEMLWVRKAPGKGLEWVSSISASGGSTYYADSVKGRFTISRDNSKNTL
FLQMNSLRAEDTAVYYCAKEPVSYVATFDYWGQGTLVTVSS (SEQ ID NO: 547)

BMS3h-202-9
EVQLLESGGGLVQPGGSLRLSCAASGFTFPTAEMLWVRQAPGKGLEWVSSISASGGSTYYADSVKGRFTISRDNSKNTL
YLQMNSLRAEDTAVYYCAKEPVSYVATFDYWGPGALVTVSS (SEQ ID NO: 548)

BMS3h-202-10
EVQLLESGGGLVQPGGSLRLSCAASGFTFPTAEMLWVRQAPGKGLEWVSSISASGGSTYYADSVKGRFTISRDNSKNTL
YLQMNSLRAEDTAVYYCAKEPVYYVATFDYWGQGTLVTVSS (SEQ ID NO: 549)

BMS3h-202-11
EVQLLESGGGLVQPGGSLRLSCAASGFTFPTAEMLWVRKAPGKGLEWVSSISASGGSTYYADSVKGRFTISRDNSKNTL
YLQMNSLRAEDAAVYYCAKEPVSYVATFDYWGQGTLVTVSS (SEQ ID NO: 550)

BMS3h-217-1
NIQMTQSPSSLSASVGDRVTITCRASHFIGTLLLTWYQHKPGKAPKLLITYGSLLQSGVPSRFSGSGSGTDFTLTISSLQ
PEDFATYYCGQGVLWPATFGQGTKVEIKR (SEQ ID NO: 551)

BMS3h-217-2
DIQMTQSPSSLSASVGDRVTITCRASHFIGTLLSWYQQKPRKAPKLLITYGSLLQSGVPSRFSGSGSGTDFTLTISSLH
PEDFATYYCGQGVLWPPTFGQGTKVEIKR (SEQ ID NO: 552)

BMS3h-217-3
DIQMTQSPSSLTASVGDRVTITCRASHFIGTLLSWYQQKPGKAPKLLVTYGSLLQSGVPSRFSGSGSGTDFTLTISNLQ
PEDFATYYCGQGVLWPPTFGQGTKVENIR (SEQ ID NO: 553)

TABLE 3-continued

Anti-Human CD40 Variable Domain Amino Acid Sequences

BMS3h-217-4
DIQMTQSPSSLSASVGDRVTITCRASHFIATLLSWYQQKPGKAPKLLITYGSLLQSGVPSRFSGSGSGTDFTLTISSLQ
PEDFATYYCGQGVLWPPTFGQGTKVEIKR (SEQ ID NO: 554)

BMS3h-217-5
DIQMTQSPSFLSASVGDRVTITCRASHFIATLLSWYQQKPGKAPKLLITYGSLLQSGVPSRFSGSGSGTDFTLTISSLQ
PEDFATYYCGQGVLWPPTFGQGTKVEIKR (SEQ ID NO: 555)

BMS3h-217-6
DIQMTQSPSSLSASVGDRVTITCRASHFIGTLLSWYQQKPGKATKLLITYGSLLQSGVPSRFSGSGSGTDFTLTISSLQ
PEDFATYYCGQGVLWPPTFGQGTKVEIKR (SEQ ID NO: 556)

BMS3h-217-7
DIQMTQSPSSLSASVGDRVTITCRASHFIGSLLSWYQHKPGKAPKLLITYGSLLQSGVPSRFSGSGSGTDFTLTISSLQ
PEDFATYYCGQGVLWPATFGQGTKVEIKR (SEQ ID NO: 557)

BMS3h-217-8
DIQMTQSPSSLSASVGDRVTITCRASHFIGTLLSWYQHKPGKAPKLLITYGSLLQSGVPSRFSGSGSGTDFTLTISSLQ
PEDFATYYCGQGVLWPATFGQGTKVEIKR (SEQ ID NO: 558)

BMS3h-217-9
DIQMTQSPSSLSASVGDRVTITCRASHFIGTLLSWYQHKPGKAPKLLITYGSMLQSGVPSRFSGSGSGTDFTLTISSLQ
PEDFATYYCGQGVLWPATFGQGTKVEIKR (SEQ ID NO: 559)

BMS3h-217-10
DIQMTQSPSSLSASVGDRVTITCRASHFIGTLLSWYQHKPGKAPKLLITYGSLLQSGVPSRFSGSGSGTEFTLTISSLQ
PEDFATYYCGQGVLWPATFGQGTKVEIKR (SEQ ID NO: 560)

BMS3h-217-11
DIQMTQSPSSLTASVGDRVTITCRASHFIGTLLSWYQHKPGKAPKLLITYGSLLQSGVPSRFSGSGSGTEFTLTISSLQ
PEDFATYYCGQGVLWPATFGQGTKVEIKR (SEQ ID NO: 561)

BMS3h-217-12
NIQMTQSPSSLSASVGDRVTITCRASHFIGTLLSWYQHKPGKAPKLLITYGSLLQSGVPSRFSGSGSGTDFTLTISSLQ
PEDFATYYCGQGVLWPATFGQGTKVEIKR (SEQ ID NO: 562)

BMS3h-217-13
DIQMTQSPSSLSASVGDRVTINCRASHFIGTLLSWYQHKPGKAPKLLITYGSLLQSGVPSRFSGSGSGTDFTLTISSLQ
PEDFATYYCGQGVLWPATFGQGTKVEIKR (SEQ ID NO: 563)

BMS3h-217-14
DIQLTQSPSSLSASVGDRVTITCRASHFIGTLLSWYQQKPGKATKLLITYGSLLQSGVPSRFSGSGSGTDFTLTISSLQ
PEDFATYYCGQGVLWPPTFGQGTKVEIKR (SEQ ID NO: 564)

BMS3h-217-15
DIQMTQSPSSLYASVGDRVTITCRVSHFIGTLLSWYQQKPGKAPKLLITYGSLLQSGVPSRFSGSGSGTDFTLSISSLQ
PEDFATYYCGQGVLWPPTFGQGTKVEIKQ (SEQ ID NO: 565)

BMS3h-217-16
DIQMTQSPSSLSASVGDRVTITCRASHFIGTLLSWYQQKPRKAPKLLITYGSLLQSGVPSRFSGSGSGTDFTLTISSLQ
PEDFATYYCGQGVLWPPTFGQGTKVEIKR (SEQ ID NO: 566)

BMS3h-217-17
DIQIIQSPSSLSASVGDRVTITCRASHFIGTLLSWYQQKPGKAPKLLITYGSLLQSGVPSRFSGSGSGTDFTLTISSLQ
PEDFATYYCGQGVLWPPTFGQGTKVEIKR (SEQ ID NO: 567)

BMS3h-217-18
DIQMTQSPSSLSASVGDRVTITCRASHFIGTLLSWYQLKPGKAPKLLITYGSLLQSGVPSRFSGSGSGTDFTLTISSLQ
PEDFATYYCGQGVLWPATFGQGTKVEIKR (SEQ ID NO: 568)

BMS3h-217-19
DIQMTQSPSSLSASVGDRVTITCRASHFIGTLLSWYQLKPGKAPKLLITYGSWLQSGVPSRFSGSGSGTDFTLTISSLQ
PEDFATYYCGQGVLWPATFGQGTKVENKR (SEQ ID NO: 569)

BMS3h-217-20
DIQMTQSPSSLSASVGDRVTITCRASHFIGTLLSWYQLKPGKAPKLLITYGSLLQRGVPSRFSGSGSGTDFTLTISSLQ
PEDFATYYCGQGVLWPATFGQGTKVEIKR (SEQ ID NO: 570)

BMS3h-217-21
DIQMTQAPSSLSASVGDRVTITCRASHFIGTLLSWYQLKPGKAPKLLITYGSLLQSGVPSRFSGSGSGTDFTLTISSLQ
PEDFATYYCGQGVLWPATFGQGTKVENKR (SEQ ID NO: 571)

BMS3h-217-22
DIQMTQSPSSLSASVGDRVTITCRASHFIGSLLSWYQQKPGKAPKLLITYGSLLQSGVPSRFSGSGSGTDFALTISSLQ
PEDFATYYCGQGVLWPATFGQGTKVEIKR (SEQ ID NO: 572)

TABLE 3-continued

Anti-Human CD40 Variable Domain Amino Acid Sequences

BMS3h-217-23
DIQMTQSPSSLSASVGDRVTITCRASHFIGSLLSWYQVKPGKAPKLLITYGSLLQSGVPSRFSGSGSGTDFTLTISSLQ
PEDFATYYCGQGVLWPATFGQGTTVEIKR (SEQ ID NO: 573)

BMS3h-217-24
DILMTQSPSSLSASVGDRVTITCRASHFIGSLLSWYQQKPGKAPKLLITYGSLLQSGVPSRFSGSGSGTDFTLTISSLQ
PEDFATYYCGQGVLWPATFGQGTKVEIKR (SEQ ID NO: 574)

BMS3h-217-25
DIQMTQSPSSLSASVGDRVTITCRASHFIGTLVSWYQQKPGKAPKLLITYGSLLQSGVPSRFSGSGSGTDFTLTISSLQ
PEDFATYYCGQGVLWPATYGQGTKVEIKR (SEQ ID NO: 575)

BMS3h-217-26
DIQMTQSPSSLSASVGDRVTITCRASHFIGTLVSWYQQKPGKAPKLLITYGSLLQSGVPSRFSGSGSGTDFTLTISSLQ
PEDFATYYCGQGVLWPATFGQGTKVENKR (SEQ ID NO: 576)

BMS3h-217-27
DIKMTQSPSSLSASVGDRVTITCRASHFIGTLVSWYQQKPGKAPKLLITYGSMLQSGVPSRFSGSGSGTDFTLTISSLQ
PEDFATYYCGQGVLWPATFGQGTKVEIKR (SEQ ID NO: 577)

BMS3h-217-28
DIQMTQSPSSLSASVGDRVTITCQASHFIGTLVSWYQQKPGKAPKLLITYGSLLQSGVPSRFSGSGSGTDFTLTISSLQ
PEDFATYYCGQGVLWPATFGQGTKVEIKR (SEQ ID NO: 578)

BMS3h-217-29
DIQMTQSPSSLSASVGDRVTITCRASHFIGTLLSWYQQKPGKAPKLLITYGSWLQSGVPSRFSGSGSGTDFTLTISSLQ
PEDFATYYCGQGVLWPATFGQGTKVEIKR (SEQ ID NO: 579)

BMS3h-217-30
DIQMTQSPSSLSASVGDRVTITCRASHFIGTLLSWYQLKPGKAPKLLITYGSWLQSGVPSRFSGSGSGTDFTLTISSLQ
PEDFATYYCGQGVLWPATFGQGTKVEIKR (SEQ ID NO: 580)

BMS3h-217-31
DIQMTQSPSSLSASVGDRVTITCRASHFIGTLLSWYQQKPGKAPKLLITYGSLLQSGVPSRFSGSGFGTDFTLTISSLQ
PEDFATYYCGQEVLWPATFGQGTKVEIKR (SEQ ID NO: 581)

BMS3h-217-32
DIQMTQSPSSLSASVGDRVSITCRASHFIGTLLSWYQQKPGKAPKLLITYGSLLQSGVPSRFSGSGFGTDFTLTISSLQ
PEDFATYYCGQEVLWPATFGQGTKVEIKR (SEQ ID NO: 582)

BMS3h-217-33
DIQMTQSPSSLSASVGDRVTITCQASHFIGTLLSWYQQKPGKAPKLLITYGSLLQSGVPSRFSGSGFGTDFTLTISSLQ
PEDFATYYCGQEVLWPATFGQGTKVEIKR (SEQ ID NO: 583)

BMS3h-217-34
DIQMTQSPSSLSASVGDRVTITCRASHFIGTLLSWYQQKPGKAPKLLITYGSLLQSGVPSRFSGSGFGTEFTLTIGSLQ
PEDFATYYCGQGVLWPATFGQGTKVEIKR (SEQ ID NO: 584)

BMS3h-217-35
DIQMTQSPSSLSASVGDRVTITCRASHFIGTLLSWYQQKPGKATKLLITYGSLLQSGVPSRFSGSGSGTDFTLTISSLQ
PEDFATYYCGQGVLWPPTFGQGTKVEIKR (SEQ ID NO: 585)

BMS3h-217-2301
DIQMTQSPSSLSASVGDRVTITCRASHFIASLLSWYQVKPGKAPKLLITYGSLLQSGVPSRFSGSGSGTDFTLTISSLQ
PEDFATYYCGQGVLWPATFGQGTTVEIKR (SEQ ID NO: 586)

BMS3h-217-2302
DIQMTQSPSSLSASVGDRVTITCRASHFIAQLLSWYQVKPGKAPKLLITYGSLLQSGVPSRFSGSGSGTDFTLTISSLQ
PEDFATYYCGQGVLWPATFGQGTTVEIKR (SEQ ID NO: 587)

BMS3h-217-2303
DIQMTQSPSSLSASVGDRVTITCRASHFIAQLLSWYQVKPGKAPKLLITYGSLLQSGVPSRFSGSGSGTDFTLTISSLQ
PEDFATYYCGQGVLWPATFGQGTTVEIRR (SEQ ID NO: 588)

BMS3h-217-2304
DIQMTQSPSSLSASVGDRVTITCRASHYIASLLSWYQVKPGKAPKLLITYGSLLQSGAPSRFSGSGSGTDFTLTISSLQ
PEDFATYYCGQGVLWPATFGQGTTVEIKR (SEQ ID NO: 589)

BMS3h-217-2305
DIQMTQSPSSLSASVGDRVTITCRASHFIGSLLSWYQVKPGKAPKLLITWASYLQSGVPSRFSGSGSGTDFTLTISSLQ
PEDFATYYCGQGVLWPATFGQGTTVEIKR (SEQ ID NO: 590)

BMS3h-217-2306
DIQMTQSPSSLSASVGDRVTITCRASHFIGSLLSWYQVKPGKAPKLLITWTSYLQSGVPSRFSGSGSGTDFTLTISSLQ
PEDFATYYCGQGVLWPATFGQGTTVEIKR (SEQ ID NO: 591)

TABLE 3-continued

Anti-Human CD40 Variable Domain Amino Acid Sequences

BMS3h-217-2307
DIQMTQSPSSLSASVGDRVTITCRASHFIGSLLSWYQVKPGKAPKLLITWSSYLQSGVPSRFSGSGSGTDFTLTISSLQ
PEDFATYYCGQGVLWPATFGQGTTVEIKR (SEQ ID NO: 592)

BMS3h-217-2308
DIQMTQSPSSLSASVGDRVTITCRASHFIGSLLSWYQVKPGKAPKLLITWGSWLQSGVPSRFSGSGSGTDFTLTISSLQ
PEDFATYYCGQGVLWPATFGQGTTVEIKR (SEQ ID NO: 593)

BMS3h-217-2309
DIQMTQSPSSLSASVGDRVTITCRASHFIGSLLSWYQVKPGKAPKLLITWASWLQSGVPSRFSGSGSGTDFTLTISSLQ
PEDFATYYCGQGVLWPATFGQGTTVEIKR (SEQ ID NO: 594)

BMS3h-217-2310
DIQMTQSPSSLSASVGDRVTITCRASHFIGSLLSWYQVKPGKAPKLLITWSSWLQSGVPSRFSGSGSGTDFTLTISSLQ
PEDFATYYCGQGVLWPATFGQGTTVEIKR (SEQ ID NO: 595)

BMS3h-217-2311
DIQMTQSPSSLSASVGDRVTITCRASHWIAQLLSWYQVKPGKAPKLLITYGSLLQSGVPSRFSGSGSGTDFTLTISSLQ
PEDFATYYCGQGVLWPATFGQGTTVEIKR (SEQ ID NO: 596)

BMS3h-217-2312
DIQMTQSPSSLSASVGDRVTITCRASHFIGSLLRWYQVKPGKAPKLLITYGSLLQSGVPSRFSGSGSGTDFTLTISSLQ
PEDFATYYCGQGVLWPATFGQGTTVEIKR (SEQ ID NO: 597)

BMS3h-217-2313
DIQMTQSPSSLSASVGDRVTITCRASHRIAQLLSWYQVKPGKAPKLLITYGSLLQSGVPSRFSGSGSGTDFTLTISSLQ
PEDFATYYCGQGVLWPATFGQGTTVEIKR (SEQ ID NO: 598)

BMS3h-217-2314
DIQMTQSPSSLSASVGDRVTITCRASHYIASLLSWYQVKPGKAPKLLITYGSLLQSGVPSRFSGSGSGTDFTLTISSLQ
PEDFATYYCGQGVLWPATFGQGTTVEIKR (SEQ ID NO: 599)

BMS3h-217-2315
DIQMTQSPSSLSASVGDRVTITCRASHFIGSLLSWYQVKPGKAPKLLIRFGSLLQSGVPSRFSGSGSGTDFTLTISSLQ
PEDFATYYCGQGVLWPATFGQGTTVEIKR (SEQ ID NO: 600)

BMS3h-217-2316
DIQMTQSPSSLSASVGDRVTITCRASHFIGSLLSWYQVKPGKAPKLLITYKSYLQSGVPSRFSGSGSGTDFTLTISSLQ
PEDFATYYCGQGVLWPATFGQGTTVEIKR (SEQ ID NO: 601)

BMS3h-217-2317
DIQMTQSPSSLSASVGDRVTITCRASHFIGSLLSWYQVKPGKAPKLLITWGSYLQSGVPSRFSGSGSGTDFTLTISSLQ
PEDFATYYCGQGVLWPATFGQGTTVEIKR (SEQ ID NO: 602)

BMS3h-217-2318
DIQMTQSPSSLSASVGDRVTITCRASHFIWGPLSWYQVKPGKAPKLLITYGSLLQSGVPSRFSGSGSGTDFTLTISSLQ
PEDSATYYCGQGVLWPATFGQGTTVEIKR (SEQ ID NO: 603)

BMS3h-217-2319
DIQMTQSPSSLSASVGDRVTITCRASHWIATLLSWYQVKPGKAPKLLITYGSLLQSGVPSRFSGSGSGTDFTLTISSLQ
PEDFATYYCGQGVLWPATFGQGTTVEIKR (SEQ ID NO: 604)

BMS3h-217-2320
DIQMTQSPSSLSASVGDRVTITCRASHFIWGPLSWYQVKPGKAPKLLITYGSLLQSGVPSRFSGSGSGTDFTLTISSLQ
PEDFATYYCGQGVLWPATFGQGTTVEIKR (SEQ ID NO: 605)

BMS3h-217-2321
DIQMTQSPSSLSASVGDRVTITCRASHFIGSLLNWYQVKPGKAPKLLITYGSLLQSGVPSRFSGSGSGTDFTLTISSLQ
PEDFATYYCGQGVLWPATFGQGTTVEIKR (SEQ ID NO: 606)

BMS3h-217-2322
GIQMTQSPSSLSASVGDRVTITCRASHFIGSLLSWYQVKPGKAPKLLITYGSWLQSGVPSRFSGSGSGTDFTLTISSLQ
PEDFATYYCGQGVLWPATFGQGTTVEIKR (SEQ ID NO: 607)

TABLE 4

Human Anti-CD40 Variable Domain Encoding Nucleotide Sequences

BMS3h-56-201
GAGGTGCAGCTGTTGGAGTCCGGGGGAGGCTTGGTACAGCCTGGGGGGTCCCTGCGTCTCTCCTGTGCAGCCTCCGGAT
TCACCTTTCGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTACTTTCAGGAGT
GGGGTCAGGGAACCCTGGTCACCGTCTCGAGC (SEQ ID NO: 608)

TABLE 4-continued

Human Anti-CD40 Variable Domain Encoding Nucleotide Sequences

BMS3h-56-258
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTACTTTCACGAGT
GGGGTCAGGGAACCCTGGTCACCGTCTCGAGC (SEQ ID NO: 609)

BMS3h-37
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCAGGCTCCAGGGAAGGGTCTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACT
GGGGTCAGGGAACCCTGGTCACCGTCTCGAGC (SEQ ID NO: 610)

BMS3h-38
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGGAGGAGGAGATGATTTGGGTCCGCCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGTTTCGTTTTGACTACT
GGGGTCAGGGAACCCTGGTCACCGTCTCGAGC (SEQ ID NO: 611)

BMS3h-41
GAGGTGCAGCTGTTGGAGTCTGGGGGAGGCTTGGTACAGCCTGGGGGGTCCCTGCGTCTCTCCTGTGCAGCCTCCGGAT
TCACCTTTACTGAGTATGAGATGATTTGGGTCCGCCAGGCTCCAGGGAAGGGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGCTTAGGTTTGACTACT
GGGGTCAGGGAACCCTGGTCACCGTCTCGAGC (SEQ ID NO: 612)

BMS3h-43
GAGGTGCAGCTGTTGGAGTCTGGGGGAGGCTTGGTACAGCCTGGGGGGTCCCTGCGTCTCTCCTGTACAGCCTCCGGAT
TCACCTTTAATATGTATGAGATGTCGTGGGTCCGCCAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGCTATGA
GGTATGCGCGTTTTGACTACTGGGGTCAGGGAACCCTGGTCACCGTCTCGAGC (SEQ ID NO: 613)

BMS3h-56
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTATTTTGACTACT
GGGGTCAGGGAACCCTGGTCACCGTCTCGAGC (SEQ ID NO: 614)

BMS3h-106
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGACTTATCATATGCAGTGGGTCCGCCAGGCTCCAGGGAAGGGTCTGGAGTGGGTCTCAATGATTGATGC
GGATGGTCTTGGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACCGGGTCCGCAGTTTGGTCAGT
TTGACTACTGGGGTCAGGGAACCCTGGTCACCGTCTCGAGC (SEQ ID NO: 615)

BMS3h-107
GAGGTGCAGCTGTTGGAGTCTGGGGGAGGCTTGGTACAGCCTGGGGGGTCCCTGCGTCTCTCCTGTGCAGCTTCCGGAT
TCACCTTTTCGGGGTATGATATGCAGTGGGTCCGCCAGGCTCCAGGGAAGGGTCTAGAGTGGGTCTCAACGATTAGTGC
GTCGGGTGTTTTACATACTACGCAGACTCCGTGAAGGGCCGGTTCACCACCTCCCGCGACAATTCCAAGAACACGCTG
TATCTGCAAATGAACAGCCTGCGTGCCGAGGACACCGCGGTATATTACTGTGCGAAATATCCTAATCGTTTTGCGCTTA
ATAATTTTGACTACTGGGGTCAGGGAACCCTGGTCACCGTCTCGAGC (SEQ ID NO: 616)

BMS3h-131
GACATCCAGATGACCCAGTCTCCATCCTCCCTGTCTGCATCTGTAGGAGACCGTGTCACCATCACTTGCCGGGCAAATA
GTTCTATTTTGTGGGCGTTAGCTTGGTACCAGCAGAAACCAGGGAAAGCCCCTAAGCTCCTGATCGAGAGTTCTTCCGG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGGTTGGCCTGGTACGTTCGGCCAAGGGACCAAGGTGGAAA
TCAAACGG (SEQ ID NO: 617)

BMS3h-193
GACATCCAGATGACCCAGTCTCCATCCTCCCTGTCTGCATCTGTAGGAGACCGTGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGCGAGTCCACCTTTGACGTTCGGCCAAGGGACCAAAGTGGAAA
TCAAACGG (SEQ ID NO: 618)

BMS3h-198
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGATCCTTATAGTTTTGACTACT
GGGGTCAGGGAACCCTGGTCACCGTCTCGAGC (SEQ ID NO: 619)

TABLE 4-continued

Human Anti-CD40 Variable Domain Encoding Nucleotide Sequences

BMS3h-202
GAGGTGCAGCTGTTGGAGTCTGGGGGAGGCTTGGTACAGCCTGGGGGGTCCCTGCGTCTCTCCTGTGCAGCCTCCGGAT
TCACCTTTCCGACTGCTGAGATGGTGTGGGTCCGCCAGGCTCCAGGGAAGGGTCTAGAGTGGGTCTCATCTATTTCGGC
TAGTGGTGGTTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGGTGAGTTATGTGGCGA
CGTTTGACTACTGGGGTCAGGGAACCCTGGTCACCGTCTCGAGC (SEQ ID NO: 620)

BMS3h-217
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 621)

BMS3h-1
GAGGTGCAGCTGTTGGAGTCTGGGGGAGGCTTGGTACAGCCTGGGGGGTCCCTGCGTCTCTCCTGTGCAGCCTCCGGAT
TCACCTTTCCGAAGAATGAGATGACGTGGGTCCGCCAGGCTCCAGGGAAGGGTCTAGAGTGGGTCTCAGCGATTGAGTC
GGATGGTCAGGCTACATACTACGCAGACTCCGTGAAGGGCCGGTTCACCATCTCCCGCGACAATTCCAAGAACACGCTG
TATCTGCAAATGAACAGCCTGCGTGCTGAGGACACCGCGGTATATTACTGTGCGAAAAATCGGATTCCTGATCTTGTGT
TTGACTACTGGGGTCAGGGAACCCTGGTCACCGTCTCGAGC (SEQ ID NO: 622)

BMS3h-2
GAGGTGCAGCTGTTGGAGTCTGGGGGAGGCTTGGTACAGCCTGGGGGGTCCCTGCGTCTCTCCTGTGCAGCCTCCGGAT
TCACCTTTGATGCTGGGGCTATGACGTGGGTCCGCCAGGCTCCAGGGAAGGGTCTAGAGTGGGTCTCATCTATTGATAA
GGAGGGTCTGTCTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGGTAGGATTCCTGGGCTGGTTT
TTGACTACTGGGGTCAGGGAACCCTGGTCACCGTCTCGAGC (SEQ ID NO: 623)

BMS3h-3
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTGATGCGGCGATGACTTGGGTCCGCCAGGCTCCAGGGAAGGGTCTAGAGTGGGTCTCAGCGATTCAGCC
TATGGGTGATGGTACATACTACGCAGACTCCGTGAAGGGCCGGTTCACCGTCTCCCGCGACAATTCCAAGAACACGCTG
TATCTGCAAATGAACAGCCTGCGTGCCGAGGACACCGCGGTATATTACTGTGCGAAAGGGCGTATTCCTACTCTTCAGT
TTGACTACTGGGGTCAGGGAACCCTGGTCACCGTCTCGAGC (SEQ ID NO: 624)

BMS3h-4
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGGATTCGCCTATGACTTGGGTCCGCCAGGCTCCAGGGAAGGGTCTAGAGTGGGTCTCAGCTATTACTTC
GAATGGTTATGAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCGTATTCCTACTCTTCATT
TTGACTACTGGGGTCAGGGAACCCTGGTCACCGTCTCGAGC (SEQ ID NO: 625)

BMS3h-5
GAGGTGCAGCTGTTGGAGTCTGGGGGAGGCTTGGTACAGCCTGGGGGGTCCCTGCGTCTCTCCTGTGCAGCCTCCGGAT
TCACCTTTGATGAGCATGATATGAGTTGGGTCCGCCAGGCTCCAGGGAAGGGTCTAGAGTGGGTCTCACGTATTGGTCC
GGATGGTTTTCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCGTATTCCTACTCTTCATT
TTGACTACTGGGGTCAGGGAACCCTGGTCACCGTCTCGAGC (SEQ ID NO: 626)

BMS3h-6
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTGAGTATCATATGTCTTGGGTCCGCCAGGCTCCAGGGAAGGGTCTAGAGTGGGTCTCAAGGATTACTCC
TCTTGGTACGCTTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCGTATTCCTTCGCTTACGT
TTGACTACTGGGGTCAGGGAACCCTGGTCACCGTCTCGAGC (SEQ ID NO: 627)

BMS3h-7
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTACGAATGCGATGAGTTGGGTCCGCCAGGCTCCAGGGAAGGGTCTGGAGTGGGTCTCAAGGATTTCGCC
GGGTGGTGATTATACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTGTATTACTGTGCGAAAGGGCGTGTTCCGGATCTGCTTT
TTGACTACTGGGGTCAGGGAACCCTGGTCACCGTCTCGAGC (SEQ ID NO: 628)

BMS3h-8
GAGGTGCAGCTGTTGGAGTCTGGGGGAGGCTTGGTACAGCCTGGGGGGTCCCTGCGTCTCTCCTGTGCAGCCTCCGGAT
TCACCTTTCCGTCTGAGGAGATGTCTTGGGTCCGCCAGGCTCCAGGGAAGGGTCTAGAGTGGGTCTCAAGGATTTCGGC
TGATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACGCCGCGGTATATTACTGTGCGAAAGGGCGTGTTCCGGATCTGCTTT
TTGACTACTGGGGTCAGGGAACCCTGGTCACCGTCTCGAGC (SEQ ID NO: 629)

BMS3h-9
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGAGGATGATATGACTTGGGTCCGCCAGGCTCCAGGGAAGGGTCTAGAGTGGGTCTCACGTATTGCGGT
TGATGGTGATCGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTAAGGTTCCGTCTCTTCATT
TTGACTACTGGGGTCAGGGAACCCTGGTCACCGTCTCGAGC (SEQ ID NO: 630)

TABLE 4-continued

Human Anti-CD40 Variable Domain Encoding Nucleotide Sequences

BMS3h-10
GAGGTGCAGCTGTTGGAGTCTGGGGGAGGCTTGGTACAGCCTGGGGGATCCCTGCGTCTCTCCTGTGCAGCCTCCGGAT
TCACCTTTAGGACGATGGATATGTCTTGGGTCCGCCAGGCTCCAGGGAAGGGTCTAGAGTGGGTCTCACGTATTACGGG
TGATGGTATGAATACATACTACGCAGACTCCGTGAAGGGCCGGTTCACCATCTCCCGCGACAATTCCAAGAACACGCTG
TATCTGCAAATGAACAGCCTGCGTGCCGGGGACACCGCGGTATATTACTGTGCGAAAGGGGTGACTCCGGATTTGACTT
TTGACTACTGGGGTCAGGGAACCCTGGTCACCGTCTCGAGC (SEQ ID NO: 631)

BMS3h-11
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGCGTGATGATATGACGTGGGTCCGCCAGGCTCCAGGGAAGGGTCTAGAGTGGGTCTCACGTATTAATGC
TGGGGGTGTGCATACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGGGGTGACTCCGGATTTGACTT
TTGACTACTGGGGTCAGGGAACCCTGGTCACCGTCTCGAGC (SEQ ID NO: 632)

BMS3h-12
GAGGTGCAGCTGTTGGAGTCTGGGGGAGGCTTGGTACAGCCTGGGGGTCCCTGCGTCTCTCCTGTGCAGCCTCCGGAT
TCACCTTTGATGATGATTCTATGACGTGGGTCCGCCAGGCTCCAGGGAAGGGTCTAGAGTGGGTCTCACGGATTTCGAG
TGATGGTGCGAGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGGTGACTCCGGATTTGACTT
TTGACTACTGGGGTCAGGGAACCCTGGTCACCGTCTCGAGC (SEQ ID NO: 633)

BMS3h-13
GAGGTGCAGCTGTTGGAGTCTGGGGGAGGCTTGGTACAGCCTGGGGGTCCCTGCGTCTCTCCTGTGCAGCCTCCGGAT
TCACCTTTACTGAGGAGGATATGACGTGGGTCCGCCAGGCTCCAGGGAAGGGTCTAGAGTGGGTCTCACGTATTGATAG
TGTTGGTGAGGGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGGTGACTCCGGATTTGACTT
TTGACTACTGGGGTCAGGGAACCCTGGTCACCGTCTCGAGC (SEQ ID NO: 634)

BMS3h-14
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTGATTCGGCGATGAGTTGGGTCCGCCAGGCTCCAGGGAAGGGTCTAGAGTGGGTCTCACGGATTGATAA
TCCTGGTCAGCATACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGGTACTGTTCCTACGCTGGAGT
TTGACTACTGGGGTCAGGGAACCCTGGTCACCGTCTCGAGC (SEQ ID NO: 635)

BMS3h-15
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGCAGCATAGTATGACTTGGGTCCGCCAGGCTCCAGGGAAGGGTCTAGAGTGGGTCTCACGTATTGATGG
TGGGGGTTATAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGGAGGTTCCTCGTCTTCATT
TTGACTACTGGGGTCAGGGAACCCTGGTCACCGTCTCGAGC (SEQ ID NO: 636)

BMS3h-16
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTCAGGAGCCTATGACTTGGGTCCGCCAGGCTCCAGGGAAGGGTCTAGAGTGGGTCTCACGGATTGCGTA
TAATGGTGGTGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATTACTCCTAATTTGACTT
TTGACTACTGGGGTCAGGGAACCCTGGTCACCGTCTCGAGC (SEQ ID NO: 637)

BMS3h-17
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGAATTATCCGATGTCTTGGGTCCGCCAGGCTCCAGGGAAGGGTCTAGAGTGGGTCTCACGTATTAATGC
TACGGGTTCTATTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGGTTATTCCTCATTTGATGT
TTGACTACTGGGGTCAGGGAACCCTGGTCACCGTCTCGAGC (SEQ ID NO: 638)

BMS3h-18
GAGGTGCAGCTGTTGGAGTCTGGGGGAGGCTTGGTACAGCCTGGGGGGTCCCTGCGTCTCTCCTGTGCAGCCTCCGGAT
TCACCTTTCGTGATTATGATATGAGTTGGGTCCGCCAGGCTCCAGGGAAGGGTCTAGAGTGGGTCTCACGTATTACTGG
TACTGGTAATAGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGCAAGGGGTGGTGCCGTATCTTGCTT
TTGACTACTGGGGTCAGGGAACCCTGGTCACCGTCTCGAGC (SEQ ID NO: 639)

BMS3h-19
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGGCTGATGCGATGACGTGGGTCCGCCAGGCTCCAGGGAAGGGTCTAGAGTGGGTCTCAAGGATTAATGT
GGATGGTGATCGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTACTGTTCCTACGCTGGAGT
TTGACTACTGGGGTCAGGGAACCCTGGTCACCGTCTCGAGC (SEQ ID NO: 640)

BMS3h-21
GAGGTGCAGCTGTTGGAGTCTGGGGGAGGCTTGGTACAGCCTGGGGGGTCCCTGCGTCTCTCCTGTGCAGCCTCCGGAT
TCACCTTTGATCGGGCGGATATGACGTGGGTCCGCCAGGCTCCAGGGAAGGGTCTAGAGTGGGTCTCAAGGATTTCGGG
GGAGGGTAAGTGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATGGTTCCTAATTTGGTTT
TTGACTACTGGGGTCAGGGAACCCTGGTCACCGTCTCGAGC (SEQ ID NO: 641)

TABLE 4-continued

Human Anti-CD40 Variable Domain Encoding Nucleotide Sequences

BMS3h-22
GAGGTGCAGCTGTTGGAGTCTGGGGGAGGCTTGGTACAGCCTGGGGGGTCCCTGCGTCTCTCCTGTGCAGCCTCCGGAT
TCACCTTTCATTGGGAGCCGATGTCTTGGGTCCGCCAGGCTCCGGGGAAGGGTCTAGAGTGGGTCTCACGTATTAATTC
TTCTGGTTGGGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATGGTTCCTAATTTGGTTT
TTGACTACTGGGGTCAGGGAACCCTGGTCACCGTCTCGAGC (SEQ ID NO: 642)

BMS3h-24
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGATGAGCCGATGACTTGGGTCCGCCAGGCTCCAGGGAAGGGTCTAGAGTGGGTCTCACGTATTCCTCC
TGAGGGTGCTCCGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATTACTCCTAATTTGACTT
TTGACTACTGGGGTCAGGGAACCCTGGTCACCGTCTCGAGC (SEQ ID NO: 643)

BMS3h-26
GAGGTGCAGCTGTTGGAGTCTGGGGGAGGCTTGGTACAGCCTGGGGGGTCCCTGCGTCTCTCCTGTGCAGCCTCCGGAT
TCACCTTTCATAATCATGATATGTCTTGGGTCCGCCAGGCTCCAGGGAAGGGTCTAGAGTGGGTCTCACGTATTAGTCG
GGGTGGTCTTCAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATTGTGCCGGATCTGCATT
TTGACTACTGGGGTCAGGGAACCCTGGTCACCGTCTCGAGC (SEQ ID NO: 644)

BMS3h-27
GAGGTGCAGCTGTTGGAGTCTGGGGGAGGCTTGGTACAGCCTGGGGGGTCCCTGCGTCTCTCCTGTGCAGCCTCCGGAT
TCACCTTTAATGAGTATCCTATGTCGTGGGTCCGCCAGGCTCCAGGGAAGGGTCTAGAGTGGGTCTCACGTATTAATGG
GGATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATTATTCCGGCTATGCAGT
TTGACTACTGGGGTCAGGGAACCCTGGTCACCGTCTCGAGC (SEQ ID NO: 645)

BMS3h-28
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGGATGTGCCTATGTCGTGGGTCCGCCAGGCTCCAGGGAAGGGTCTAGAGTGGGTCTCAAGGATTGATCC
TTATGGTTCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTATTATGCCTAGTCTTACTT
TTGACTACTGGGGTCAGGGAACCCTGGTCACCGTCTCGAGC (SEQ ID NO: 646)

BMS3h-29
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGATTATGATATGTCTTGGGTCCGCCAGGCTCCAGGGAAGGGTCTAGAGTGGGTCTCACGTATTTCGGC
GCTTGGTGCTACTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTCAGCTTCCGGCGTTGGAGT
TTGACTACTGGGGTCAGGGAACCCTGGTCACCGTCTCGAGC (SEQ ID NO: 647)

BMS3h-30
GAGGTGCAGCTGTTGGAGTCTGGGGGAGGCTTGGTACAGCCTGGGGGGTCCCTGCGTCTCTCCTGTGCAGCCTCCGGAT
TCACCTTTAAGCGTTATTATATGACTTGGGTCCGCCAGGCTCCAGGGAAGGATCTAGAGTGGGTCTCAGGTATTGTTCC
TTCTGGTAATAGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTAGGATTCCGGATCTGCATT
TTGACTACTGGGGTCAGGGAACCCTGGTCACCGTCTCGAGC (SEQ ID NO: 648)

BMS3h-31
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGATTATGATATGACTTGGGTCCGCCAGGCTCCAGGGAAGGGTCTAGAGTGGGTCTCAAGGATTTCTCC
GACGGGTGGGCAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTGTTATTCCGTATTTGTCTT
TTTCTCCGTTTGACTACTGGGGTCAGGGAACCCTGGTCACCGTCTCGAGC (SEQ ID NO: 649)

BMS3h-32
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTAAGTATTGGATGGGTTGGGCCCGCCAGGCTCCAGGGAAGGGTCTAGAGTGGGTCTCATCGATTGATTC
GCATGGTGCTGGTACATACTACGCAGACTCCGTGAAGGGCCGGTTCACCATCTCCCGCGACAATTCCAAGAACACGCTG
TATCTGCAAATGAACAGCCTGCGTGTCGAGGACACCGCGGTATATTACTGTGCGAAAGGTGCTCCTAAGTTTATGACTA
CGTATACGTTTGACTACTGGGGTCAGGGAACCCTGGTCACCGTCTCGAGC (SEQ ID NO: 650)

BMS3h-33
GAGGTGCAGCTGTTGGAGTCTGGGGGAGGCTTGGTACAGCCTGGGGGGTCCCTGCGTCTCTCCTGTGCAGCCTCCGGAT
TCACCTTTTTGTCTTATCCGATGCATTGGGTCCGCCAGGCTCCAGGGAAGGGTCTAGAGTGGGTCTCATCGATTGATTC
GAGGGGTTCGGTTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTCATAGTTGGACGTTTGACT
ACTGGGGTCAGGGAACCCTGGTCACCGTCTCGAGC (SEQ ID NO: 651)

BMS3h-34
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGAATAGTAATATGACTTGGGTCCGCCAGGCTCCAGGGAAGGGTCTAGAGTGGGTCTCACGTATTAATCC
GGATGGTGGGTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCGTATTCCTACTCTTCATT
TTGACTACTGGGGTCAGGGAACCCTGGTCACCGTCTCGAGC (SEQ ID NO: 652)

TABLE 4-continued

Human Anti-CD40 Variable Domain Encoding Nucleotide Sequences

BMS3h-35
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGCCGAGGAGGATGGGTTGGGTCCGCCAGGCTCCAGGGAAGGGTCTAGAGTGGGTCTCATCGATTGATGA
TATTGGTCGTAGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGGAAGGGGCGCAGGGTGTGTTGTTGT
TTGACTACTGGGGTCAGGGAACCCTGGTCACCGTCTCGAGC (SEQ ID NO: 653)

BMS3h-36
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGGATTATAGGATGGTTTGGGTCCGCCAGGCTCCAGGGAAGGGTCTAGAGTGGGTCTCATCGATTTCTAC
TTCTGGTGAGCTGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGGAAACGGCGGGTCAGTTTTTTGACT
ACTGGGGTCAGGGAACCCTGGTCACCGTCTCGAGC (SEQ ID NO: 654)

BMS3h-39
GAGGTGCAGCTGTTGGAGTCTGGGGGAGGCTTGGTACAGCCTGGGGGGTCCCTGCGTCTCTCCTGTGCAGCCTCCGGAT
TCACCTTTCCGGAGTATGAGATGGTTTGGGTCCGCCAGGCTCCAGGGAAGGGTCTGGAGTGGGTCTCAGCGATTTCGCG
TGAGGGTCGGGCTACATACTACGCAGACTCCGTGAAGGGCCGGTTCACCATCTCCCGCGACAATTCCAAGAACACGCTG
TATCTGCAAATGAACAACCTGCGTGCCGAGGATACCGCGGTATATTACTGTGCGAAAGAGCCTGTTCGTTTTGACTACT
GGGGTCAGGGAACCCTGGTCACCGTCTCGAGC (SEQ ID NO: 655)

BMS3h-40
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGACTTATGAGATGCTTTGGGTCCGCCAGGCTCCAGGGAAGGGTCTAGAGTGGGTCTCATCTATTTCTTC
TTCTGGTAATTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGACCGCTGATGTTTGACTACT
GGGGTCAGGGAACCCTGGTCACCGTCTCGAGC (SEQ ID NO: 656)

BMS3h-42
GAGGTGCAGCTGTTGGAGTCTGGGGGAGGCTTGGTACAGCCTGGGGGGTCCCTGCGTCTCTCCTGTGCAGCCTCCGGAT
TCACCTTTGATACTGAGGAGATGAGTTGGGTCCGCCAGGCTCCAGGGAAGGGTCTAGAGTGGGTCTCAGCGATTAGTCC
TAATGGTGCTTTTACATTCTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCTATTCTGTTTGACTACT
GGGGTCAGGGAACCCTGGTCACCGTCTCGAGC (SEQ ID NO: 657)

BMS3h-44
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTCATTATGATATGGTTTGGGTCCGCCAGGCTCCAGGGAGGGGTCTAGAGTGGGTCTCAACTATTAATGG
TGCTGGTCTGAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGCAAAGTGCTAGTCGTATTTTTGACT
ACTGGGGTCAGGGAACCCTGGTCACCGTCTCGAGC (SEQ ID NO: 658)

BMS3h-45
GAGGTGCAGCTGTTGGAGTCTGGGGGAGGCTTGGTACAGCCTGGGGGGTCCCTGCGTCTCTCCTGTGCAGCCTCCGGAT
TCACCTTTAGGAGTTATGAGATGGCGTGGGTCCGCCAGGCTCCAGGGAAGGGTCTAGAGTGGGTCTCATCTATTAGTAC
TCTGGGTACGAAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGCAATCTTCTACTCATATTTTTGACT
ACTGGGGTCAGGGAACCCTGGTCACCGTCTCGAGC (SEQ ID NO: 659)

BMS3h-46
GAGGTGCAGCTGTTGGAGTCTGGGGGAGGCTTGGTACAGCCTGGGGGGTCCCTGCGTCTCTCCTGTGCAGCCTCCGGAT
TCACCTTTATTAGGTATGAGATGGCTTGGGTCCGCCAGGCTCCAGGGAAGGGTCTAGAGTGGGTCTCAAGTATTTCGTC
GTCTGGTTGGACGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAAGTGATGCTCATATTTTTGACT
ACTGGGGTCAGGGAACCCTGGTCACCGTCTCGAGC (SEQ ID NO: 660)

BMS3h-47
GAGGTGCAGCTGTTGGAGTCTGGGGGAGGCTTGGTACAGCCTGGGGGGTCCCTGCGTCTCTCCTGTGCAGCCTCCGGAT
TCACCTTTTATGCTTATGAGATGGCTTGGGTCCGCCAGGCTCCAGGGAAGGGTCTAGAGTGGGTCTCATCTATTTCGGA
TGATGGTACGCGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGATCTGGGGCAGGGGTTTGACT
ACTGGGGTCAGGGAACCCTGGTCACCGTCTCGAGC (SEQ ID NO: 661)

BMS3h-48
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGATCATGGGATGACGTGGGTCCGCCAGGCTCCAGGGAAGGGTCTAGAGTGGGTCTCAGGGATTGGTCC
GTCTGGTGAGGCGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGATCGTATTCCTAATCTTGTGT
TTGACTACTGGGGTCAGGGAACCCTGGTCACCGTCTCGAGC (SEQ ID NO: 662)

BMS3h-49
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTCTCAGGATATGTCTTGGGTCCGCCAGGCTCCAGGGAAGGGTCTAGAGTGGGTCTCAGGTATTAGTCC
GAATGGTTGGGATACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGATAGGTCTGATTTTGACTACT
GGGGTCAGGGAACCCTGGTCACCGTCTCGAGC (SEQ ID NO: 663)

TABLE 4-continued

Human Anti-CD40 Variable Domain Encoding Nucleotide Sequences

BMS3h-50
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGGATTATGATATGTGGTGGGTCCGCCAGGCTCCAGGGAAGGGTCTAGAGTGGGTCTCAAGGATTCGTCA
TCCGGGTGGTGTTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGCTGTTCCTAAGGGTTTTGACT
ACTGGGGTCAGGGAACCCTGGTCACCGTCTCGAGC (SEQ ID NO: 664)

BMS3h-51
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGTTTATTGGATGACTTGGGTCCGCCAGGCTCCAGGGAAGGGTCTAGAGTGGGTCTCATCTATTGATCC
GCAGGGTGGGATGACATACTACGCAGACTCCGTGAAGGGCCGGTTCACCATCTCTCGCGACAATTCCAAGAACACGCTG
TATCTGCAAATGAACAGCCTGCGTGCCGAGGATACCGCGGTATATTACTGTGCGAAAGCGCGTATTCCTAATTTGGAGT
TTGACTACTGGGGTCAGGGAACCCTGGTCACCGTCTCGAGC (SEQ ID NO: 665)

BMS3h-52
GAGGTGCAGCTGTTGGAGTCTGGGGGAGGCTTGGTACAGCCTGGGGAGTCCCTGCGTCTCTCCTGTGCAGCCTCCGGAT
TCACCTTTAGTGCTTATGATATGACGTGGGTCCGCCAGGCTCCAGGGAAGGGTCTTGAGTGGGTCTCACGTATTAATCC
GACGGGTTCTTATACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGCTAAGATTCCGAATTTGGTTT
TTGACTACTGGGGTCAGGGAACCCTGGTCACCGTCTCGAGC (SEQ ID NO: 666)

BMS3h-53
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGGATAGTGAGATGATGTGGGTCCGCCAGGCTCCAGGGAAGGGTCTAGAGTGGGTCTCAGGTATTGCGCA
TAATGGTGGGCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGCTGGTCATCCTCAGCAGACTG
AGGCTTTTGACTACTGGGGTCAGGGAACCCTGGTCACCGTCTCGAGC (SEQ ID NO: 667)

BMS3h-54
GAGATGCAGCTGTTGGAGTCTGGGGGAGGCTTGGTACAGCCTGGGGGGTCCCTGCGTCTCTCCTGTGCAGCCTCCGGAT
TCACCTTTGCTACTTATGATATGTATTGGGTCCGCCAGGCTCCAGGGAAGGGTCTAGAGTGGGTCTCAAAGATTTCTCC
GAATGGTTGGAGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATATCAGACGCATTTTGACTACT
GGGGTCAGGGAACCCTGGTCACCGTCTCGAGC (SEQ ID NO: 668)

BMS3h-55
GAGGTGCAGCTGTTGGAGTCTGGGGGAGGCTTGGTACAGCCTGGGGGGTCCCTGCGTCTCTCCTGTGCAGCCTCCGGAT
TCACCTTTAGTGTTTATGATATGAGGTGGGTCCGCCAGGCTCCAGGGAAGGGTCTAGAGTGGGTCTCAACGATTTCTTC
TTCGGGTACGTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATATCCTAAGAATTTTGACTACT
GGGGTCAGGGAACCCTGGTCACCGTCTCGAGC (SEQ ID NO: 669)

BMS3h-57
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTCATGAGGATATGACTTGGGTCCGCCAGGCTCCAGGGAAGGGTCTAGAGTGGGTCTCAAGTATTAGTCC
GAATGGTTGGGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACGTACTAGGAGTAAGTTTGACT
ACTGGGGTCAGGGAACCCTGGTCACCGTCTCGAGC (SEQ ID NO: 670)

BMS3h-58
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGAAGTATATTATGGGTTGGGCCCGCCAGGCTCCAGGGAAGGGTCTAGAGTGGGTCTCAACGATTGATTA
TTGGGGTCAGCATACATACTACGCAGACTCCGTGAAGGGCCGGTTCACTATCTCCCGCGACAATTCCAAGAACACGCTG
TATCTGCAAATGAACAGCCTGCGTGCCGAGGACACCGCGGTATATTACTGTGCGAAACGTAGTCATCTTATTCCTCTGC
AGTTTGACTACTGGGGTCAGGGAACCCTGGTCACCGTCTCGAGC (SEQ ID NO: 671)

BMS3h-59
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTGATTATGCGATGGGGTGGGTCCGCCAGGCTCCAGGGAAGGGTCTGGAGTGGGTCTCAACGATTTCGTA
TGTGGGTTATTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAAGGCTCTGCGGGGGAGGCGT
TTACGGAGCGTTTTGACTACTGGGGTCAGGGAACCCTGGTCACCGTCTCGAGC (SEQ ID NO: 672)

BMS3h-60
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTCCGTATATGATGCATTGGGTCCGCCAGGCTCCAGGGAAGGGTCTAGAGTGGGTCTCAACGATTGAGGT
TAATGGTAATAGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATGGGTTGGTTCGAAGACGTCGT
CGGATAAGAGTTTTGACTACTGGGGTCAGGGAACCCTGGTCACCGTCTCGAGC (SEQ ID NO: 673)

BMS3h-61
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTACGACGGAGATGGCTTGGGTCCGCCAGGCTCCAGGGAAGGGTCTAGAGTGGGTCTCAAGTATTGGTAG
TGCTGGTGCTTGGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAATTGGTGGGCATCCTCAGGGTC
AGTTTGACTACTGGGGTCAGGGAACCCTGGTCACCGTCTCGAGC (SEQ ID NO: 674)

TABLE 4-continued

Human Anti-CD40 Variable Domain Encoding Nucleotide Sequences

BMS3h-62
GAGGTGCAGCTGTTGGAGTCTGGGGGAGGCTTGGTACAGCCTGGGGGGTCCCTGCGCCTCTCCTGTGCAGCCTCCGGAT
TCACCTTTCCTAGGGAGTGGATGGCTTGGGTCCGCCAGGCTCCAGGGAAGGGTCTAGAGTGGGTCTCAAGTATTCAGCC
TATGGGTCAGACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAATATTCTCGGAATAAGGGGTTTT
TTGACTACTGGGGTCAGGGAACCCTGGTCACCGTCTCGAGC (SEQ ID NO: 675)

BMS3h-63
GAGGTGCAGCTGTTGGAGTCTGGGGGAGGCTTGGTACAGCCTGGGGGGTCCCTGCGTCTCTCCTGTGCAGCCTCCGGAT
TCACCTTTACGAGTGAGTATATGGGGTGGGTCCGCCAGGCTCCAGGGAAGGGTCTAGAGTGGGTCTCATCTATTCAGAG
GTATGGTAGTACGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACATGAGTCTAATTGGGAGACTT
TTGACTACTGGGGTCAGGGAACCCTGGTCACCGTCTCGAGC (SEQ ID NO: 676)

BMS3h-70
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGGTGTATAGTATGCAGTGGGTCCGCCAGGCTCCAGGGAAGGGTCTAGAGTGGGTCTCAGCGATTACTCC
TAATGGTACTCGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAACTCTTGGTCGGGGTTCTTATC
CTGGTGTTGATTTTGACTACTGGGGTCAGGGAACCCTGGTCACCGTCTCGAGC (SEQ ID NO: 677)

BMS3h-71
GAGGTGCAGCTGTTGGAGTCTGGGGGAGGCTTGGTACAGCCTGGGGGGTCCCTGCGTCTCTCCTGTGCAGCCTCCGGAT
TCACCTTTCCGAGTTATGCTATGACGTGGGTCCGCCAGGCTCCAGGGAAGGGTCTGGAGTGGGTCTCACGTATTACGGC
GGATGGTACTGTTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTTCTATTCCGATGCTTACGT
TTGACTACTGGGGTCAGGGAACCCTGGTCACCGTCTCGAGC (SEQ ID NO: 678)

BMS3h-72
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGACTTATGATATGATTTGGGTCCGCCAGGCTCCAGGGAAGGGTCTAGAGTGGGTCTCAGCTATTTCTCC
TAATGGTACTGGTATATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAATCAGAGTGTTCATCATGCTG
TTTTTGACTACTGGGGTCAGGGAACCCTGGTCACCGTCTCGAGC (SEQ ID NO: 679)

BMS3h-73
GAGGTGCAGCTGTTGGAGTCTGGGGGAGGCTTGGTACAGCCTGGGGGTCCCTGCGTCTCTCCTGTGCAGCCTCCGGAT
TCACCTTTGAGAATTATGAGATGACGTGGGTCCGCCAGGCTCCAGGGAAGGGTCTAGAGTGGGTCTCACGTATTGCGCC
GCATGGTCGGCTTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGGTCAGATTCCGATGCTTGATT
TTGACTACTGGGGTCAGGGAACCCTGGTCACCGTCTCGAGC (SEQ ID NO: 680)

BMS3h-74
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGCATTATATGATGATGTGGGTCCGCCAGGCTCCAGGGAAGGGTCTAGAGTGGGTCTCAACGATTTCTCA
TTTTGGTGATATTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAAATGATATGGTGATGAAGAATG
GGGGGTTTGACTACTGGGGTCAGGGAACCCTGGTCACCGTCTCGAGC (SEQ ID NO: 681)

BMS3h-75
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGAGGTATGATATGAGTTGGGTCCGCCAGGCTCCAGGGAAGGGTCTAGAGTGGGTCTCACGTATTGATTC
GCGGGGTTGGTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGTTGGTGCCGCATCTGAGGT
TTGACTACTGGGGTCAGGGAACCCTGGTCACCGTCTCGAGC (SEQ ID NO: 682)

BMS3h-76
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGAATGCGCAGATGACTTGGGTCCGCCAGGCTCCAGGGAAGGGTCTAGAGTGGGTCTCAAGGATTGATGC
TATGGGTGATGCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTAAGGTTCCGAGTATTGACT
ACTGGGGTCAGGGAACCCTGGTCACCGTCTCGAGC (SEQ ID NO: 683)

BMS3h-77
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGAATGCGCAGATGACTTGGGTCCGCCAGGCTCCAGGGAAGGGTCTAGAGTGGGTCTCAAGGATTGATGC
TATGGGTGATGCTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGGTGTTATTCCGGCGTTTGACT
ACTGGGGTCAGGGAACCCTGGTCACCGTCTCGAGC (SEQ ID NO: 684)

BMS3h-78
GAGGTGCAGCTGTTGGAGTCTGGGGGAGGCTTGGTACAGCCTGGGGGGTCCCTGCGTCTCTCCTGTGCAGCCTCCGGAT
TCACCTTTCAGAATGATCGGATGCATTGGGTCCGCCAGGCTCCAGGGAAGGGTCTAGAGTGGGTCTCATCGATTTCTGC
TACTGGTGGTGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACAGACGGGTACGAATCGTTTTG
ACTACTGGGGTCAGGGAACCCTGGTCACCGTCTCGAGC (SEQ ID NO: 685)

TABLE 4-continued

Human Anti-CD40 Variable Domain Encoding Nucleotide Sequences

BMS3h-79
GAGGTGCAGCTGTTGGAGTCTGGGGGAGGCTTGGTACAGCCTGGGGGGTCCCTGCGTCTCTCCTGTGCAGCCTCCGGAT
TCACCTTTAATCAGCCTTATATGTCGTGGGTCCGCCAGGCTCCAGGGAAGGGTCTGGAGTGGGTCTCATCTATTGATGC
TTCGGGTGGTACTACATACTACGCAGACTCCGTGAAGGGCCGGTTCACCATCTCCCGCGACAATTCCAAGAACACGCTG
TATCTGCAAATGAACAGCCTGCGTGCCGAGGACGCCGCGGTATATTACTGTGCGAAAGATCGTATTCCTAATCTTGTGT
TTGACTACTGGGGTCAGGGAACCCTGGTCACCGTCTCGAGC (SEQ ID NO: 686)

BMS3h-80
GAGGTGCAGCTGTTGGAGTCTGGGGGAGGCTTGGTACAGCCTGGGGGGTCCCTGCGTCTCTCCTGTGCAGCCTCCGGAT
TCACCTTTGATAATGAGAATATGACTTGGGTCCGCCAGGCTCCAGGGAAGGGTCTAGAGTGGGTCTCACGTATTGATGG
TGGGGGTTATAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCAGGTTCCTGAGCTGCTGT
TTGACTACTGGGGTCAGGGAACCCTGGTCACCGTCTCGAGC (SEQ ID NO: 687)

BMS3h-81
GAGGTGCAGCTGTTGGAGTCTGGGGGAGGCTTGGTACAGCCTGGGGGGTCCCTGCGTCTCTCCTGTGCAGCCTCCGGAT
TCACCTTTGTTTCGTCGAATATGACTTGGGTCCGCCAGGCTCCAGGGAAGGGTCTAGAGTGGGTCTCAGCTATTAGTGG
TAGTGGTGGTAGCACATACTATGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTCGGATTCCTACGTTGGTGT
TTGACTACTGGGGTCAGGGAACCCTGGTCACCGTCTCGAGC (SEQ ID NO: 688)

BMS3h-82
GAGGTGCAGCTGTTGGAGTCTGGGGGAGGCTTGGTACAGCCTGGGGGGTCCCTGCGTCTCTCCTGTGCAGCCTCCGGAT
TCACCTTTGTTTCGTCGAATATGACTTGGGTCCGCCAGGCTCCAGGGAAGGGTCTAGAGTGGGTCTCAGCTATTAGTGG
TAGTGGTGGTAGCACATACTATGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGATCGTATTCCTAATCTTGTGT
TTGACTACTGGGGTCAGGGAACCCTGGTCACCGTCTCGAGC (SEQ ID NO: 689)

BMS3h-83
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTGATGATTCGATGAGTTGGGTCCGCCAGGCTCCAGGGAAGGGTCTAGAGTGGGTCTCACGTATTAATGA
TGCTGGTAGTTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTACTATTCCTCTTCTGGAGT
TTGACTACTGGGGTCAGGGAACCCTGGTCACCGTCTCGAGC (SEQ ID NO: 690)

BMS3h-84
GAGATGCAGCTGTTGGAGTCTGGGGGAGGCTTGGTACAGCCTGGGGGGTCCCTGCGTCTCTCCTGTGCAGCCTCCGGAT
TCACCTTTGTTTCGGATACTATGAGTTGGGTCCGCCAGGCTCCAGGGAAGGGTCTAGAGTGGGTCTCACGTATTGATGG
GACTGGTGGTGATACATACTACGCAGACTCCGTGAAGGGCCGGTTCACCATCTCCCGCGACAATTCCAAGAACACGCTG
TATCTGCAAATGAACAGCCTGCGTGCCGGGGACACCGCGGTATATTACTGTGCGAAAGGGCTTATTCCTGATCTTCAGT
TTGACTACTGGGGTCAGGGAACCCTGGTCACCGTCTCGAGC (SEQ ID NO: 691)

BMS3h-85
GAGGTGCAGCTGTTGGAGTCTGGGGGAGGCTTGGTACAGCCTGGGGGGTCCCTGCGTCTCTCCTGTGCAGCCTCCGGAT
TCACCTTTGATGAGGAGGAGATGACGTGGGTCCGCCAGGCTCCAGGGAAGGGTCTAGAGTGGGTCTCACGTATTATTGG
TGGTGGTCATGAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTACTATTCCTCTTCTGGAGT
TTGACTACTGGGGTCAGGGAACCCTGGTCACCGTCTCGAGC (SEQ ID NO: 692)

BMS3h-86
GAGGTGCAGCTGTTGGAGTCTGGGGGAGGCTTGGTACAGCCTGGGGGGTCCCTGCGTCTCTCCTGTGCAGCCTCCGGAT
TCACCTTTGATAATGAGAATATGACTTGGGTCCGCCAGGCTCCAGGGAAGGATCTAGAGTGGGTCTCACGGATTACTGA
GAGGGGTGATGTGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTACTGTTCCTACGCTGGAGT
TTGACTACTGGGGTCAGGGAACCCTGGTCACCGTCTCGAGC (SEQ ID NO: 693)

BMS3h-87
GAGGTGCAGCTGTTGGAGTCTGGGGGAGGCTTGGTACAGCCTGGGGGGTCCCTGCGTCTCTCCTGTGCAGCCTCCGGAT
TCACCTTTGATGAGGAGGAGATGACGTGGGTCCGCCAGGCTCCAGGGAAGGGTCTAGAGTGGGTCTCACGTATTATTGG
TGGTGGTCATGAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTACTGTTCCTACGCTGGAGT
TTGACTACTGGGGTCAGGGAACCCTGGTCACCGTCTCGAGC (SEQ ID NO: 694)

BMS3h-88
GAGGTGCAGCTGTTGGAGTCTGGGGGAGGCTTGGTACAGCCTGGGGGGTCCCTGCGTCTCTCCTGTGCAGCCTCCGGAT
TCACCTTTCATGAGACGGAGATGACGTGGGTCCGCCAGGCTCCAGGGAAGGGTCTAGAGTGGGTCTCAGCTATTAATCG
GCTGGGTCAGGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTAGGATTCCTGGGCTGGTTT
TTGACTACTGGGGTCAGGGAACCCTGGTCACCGTCTCGAGC (SEQ ID NO: 695)

BMS3h-89
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTGATGATTCGATGAGTTGGGTCCGCCAGGCTCCAGGGAAGGGTCTAGAGTGGGTCTCACGTATTAATGA
TGCTGGTAGTTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTACTGTTCCTACGCTGGAGT
TTGACTACTGGGGTCAGGGAACCCTGGTCACCGTCTCGAGC (SEQ ID NO: 696)

TABLE 4-continued

Human Anti-CD40 Variable Domain Encoding Nucleotide Sequences

BMS3h-90
GAGGTGCAGCTGTTGGAGTCTGGGGGAGGCTTGGTACAGCCTGGGGGGTCCCTGCGTCTCTCCTGTGCAGCCTCCGGAT
TCACCTTTGATAATGAGAATATGACTTGGGTCCGCCAGGCTCCAGGGAAGGATCTAGAGTGGGTCTCACGGATTACTGA
GAGGGGTGATGTGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTCGGATTCCTACGTTGGTGT
TTGACTACTGGGGTCAGGGAACCCTGGTCACCGTCTCGAGC (SEQ ID NO: 697)

BMS3h-91
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTGATGATTCGATGAGTTGGGTCCGCCAGGCTCCAGGGAAGGGTCTAGAGTGGGTCTCACGTATTAATGA
TGCTGGTAGTTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATTACTCCTAATTTGACTT
TTGACTACTGGGGTCAGGGAACCCTGGTCACCGTCTCGAGC (SEQ ID NO: 698)

BMS3h-92
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGATGAGCCGATGACTTGGGTCCGCCAGGCTCCAGGGAAGGGTCTAGAGTGGGTCTCACGTATTCCTCC
TGAGGGTGCTCCGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCTTATTCCTGATCTTCAGT
TTGACTACTGGGGTCAGGGAACCCTGGTCACCGTCTCGAGC (SEQ ID NO: 699)

BMS3h-93
GAGGTGCAGCTGTTGGAGTCTGGGGGAGGCTTGGTACAGCCTGGGGGGTCCCTGCGTCTCTCCTGTGCAGCCTCCGGAT
TCACCTTTCAGGATAGTGATATGACGTGGGTCCGCCAGGCTCCAGGGAAGGGTCTAGAGTGGGTCTCAGCTATTGCTGC
GCCTGGTGGTAGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGATCGTATTCCTAATCTTAGGT
TTGACTACTGGGGTCAGGGAACCCTGGTCACCGTCTCGAGC (SEQ ID NO: 700)

BMS3h-94
GAGGTGCAGCTGTTGGAGTCTGGGGGAGGCTTGGTACAGCCTGGGGGGTCCCTGCGTCTCTCCTGTGCAGCCTCCGGAT
TCACCTTTGTTTCGGATACTATGAGTTGGGTCCGCCAGGCTCCAGGGAAGGGTCTAGAGTGGGTCTCACGTATTGATGG
GACTGGTGGTGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCAGGTTCCTGAGCTGCTGT
TTGACTACTGGGGTCAGGGAACCCTGGTCACCGTCTCGAGC (SEQ ID NO: 701)

BMS3h-95
GAGGTGCAGCTGTTGGAGTCTGGGGGAGGCTTGGTACAGCCTGGGGGGTCCCTGCGTCTCTCCTGTGCAGCCTCCGGAT
TCACCTTTCAGGATAGTGATATGACGTGGGTCCGCCAGGCTCCAGGGAAGGGTCTAGAGTGGGTCTCAGCTATTGCTGC
GCCTGGTGGTAGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGATCGTATTCCTAATCTTGTGT
TTGACTACTGGGGTCAGGGAACCCTGGTCACCGTCTCGAGC (SEQ ID NO: 702)

BMS3h-96
GAGGTGCAGCTGTTGGAGTCTGGGGGAGGCTTGGTACAGCCTGGGGGGTCCCTGCGTCTCTCCTGTGCAGCCGCCGGAT
TCACCTTTGATCTGGCGGAGATGACTTGGGTCCGCCAGGCTCCAGGGAAGGGTCTAGAGTGGGTCTCACGTATTGATGA
GGATGGTGCTTCTACATACTACGCAGACTCCGTGAAGGGCCGGTTCACCATCTCCCGCGACAATTCCAAGAACACGCTG
TATCTGCAAATGAACAGCCTGCGTGCCGAGGACGCCGCGGTATATTACTGTGCGAAGGTGTTATTCCGTCTCTGACTT
TTGACTACTGGGGTCAGGGAACCCTGGTCACCGTCTCGAGC (SEQ ID NO: 703)

BMS3h-97
GAGGTGCAGCTGTTGGAGTCTGGGGGAGGCTTGGTACAGCCTGGGGGGTCCCTGCGTCTCTCCTGTGCAGCCTCCGGAT
TCACCTTTACTGATAAGCATATGAGTTGGGTCCGCCAGGCTCCAGGGAAGGGTCTAGAGTGGGTCTCACGGATTTCGCC
TGATGGTACGTATACATACTACGCAGACTCCGTGAAGGGCCGGTTCACCATCTCCCGCGACAATTCCAAGAACACGCTG
TATCTGCAAATGAACAGCCTGCGTGCCGAGGACGCCGCGGTATATTACTGTGCGAAGGTGTTATTCCGTCTCTGACTT
TTGACTACTGGGGTCAGGGAACCCTGGTCACCGTCTCGAGC (SEQ ID NO: 704)

BMS3h-98
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGAGGATATATGACTTGGGTCCGCCAGGCTCCAGGGAAGGGTCTAGAGTGGGTCTCACGTATTGCGGT
TGATGGTGATCGGACATACTACGCAGACTCCGTGAAGGGCCGGTTCACCATCTCCCGCGACAATTCCAAGAACACGCTG
TATCTGCAAATGAACAGCCTGCGTACCGAGGACACCGCGGTATATTACTGTGCGAAAGGGAAGACGCCGCATCTTGTGT
TTGACTACTGGGGTCAGGGAACCCTGGTCACCGTCTCGAGC (SEQ ID NO: 705)

BMS3h-99
GAGGTGCAGCTGTTGGAGTCTGGGGGAGGCTTGGTACAGCCTGGGGGGTCCCTGCGTCTCTCCTGTGCAGCCGCCGGAT
TCACCTTTGATCTGGCGGAGATGACTTGGGTCCGCCAGGCTCCAGGGAAGGGTCTAGAGTGGGTCTCACGTATTGATGA
GGATGGTGCTTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGTCAGGTTCCTGCTTTGGTTT
TTGACTACTGGGGTCAGGGAACCCTGGTCACCGTCTCGAGC (SEQ ID NO: 706)

BMS3h-100
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGGATTCGATGATGTCGTGGGTCCGCCAGGCGCCAGGGAAGGGTCTAGAGTGGGTCTCACGGATTGATCC
TGGGGGTGCTCAGACATACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGGTGACTCCGGATTTGACTT
TTGACTACTGGGGTCAGGGAACCCTGGTCACCGTCTCGAGC (SEQ ID NO: 707)

TABLE 4-continued

Human Anti-CD40 Variable Domain Encoding Nucleotide Sequences

BMS3h-101
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGCATGCGGATATGAGTTGGGTCCGCCAGGCTTCAGGGAAGGGTCTAGAGTGGGTCTCACGTATTGATAA
TAGTGGTCAGTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGGTGACTCCGGATTTGACGT
TTGACTACTGGGGTCAGGGAACCCTGGTCACCGTCTCGAGC (SEQ ID NO: 708)

BMS3h-102
GAGGTGCAGCTGTTGGAGTCTGGGGGAGGCTTGGTACAGCCTGGGGGGTCCCTGCGTCTCTCCTGTGCAGCCTCCGGAT
TCACCTTTAGTGAGGCGGAGATGAATTGGGTCCGCCAGGCTCCAGGGAAGGGTCTAGAGTGGGTCTCACGTATTACGAC
GGATGGTGATTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCGTATTCCTACTCTTCATT
TTGACTACTGGGGTCAGGGAACCCTGGTCACCGTCTCGAGC (SEQ ID NO: 709)

BMS3h-103
GAGGTGCAGCTGTTGGAGTCTGGGGGAGGCTTGGTACAGCCTGGGGGGTCCCTGCGTCTCTCCTGTGCAGCCTCAGGAT
TCACCTTTGATGATAGTGATATGACTTGGGTCCGCCAGGCTCCAGGGAAGAGTCTAGAGTGGGTCTCATATATTCGGGG
TGATGATGATGAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAATCGGATTCCTGATCTTGTGT
TTGACTACTGGGGTCAGGGAACCCTGGTCACCGTCTCGAGC (SEQ ID NO: 710)

BMS3h-108
GAGGTGCAGCTGTTGGAGTCTGGGGGAGGCTTGGTACAGCCTGGGGGGTCCCTGCGTCTCTCCTGTGCAGCCTCCGGAT
TCACCTTTAATGTGGCGGATATGCAGTGGGTCCGCCAGGCTCCAGGGAAGGGTCTAGAGTGGGTCTCAAGTATTAGTCC
GAATGGTTGGGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACATGCTTCTACGGAGGGGCCGA
CTGCTTTTGACTACTGGGGTCAGGGAACCCTGGTCACCGTCTCGAGC (SEQ ID NO: 711)

BMS3h-109
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGCGTATGATATATGGGGTGGGTCCGCCAGGCTCCAGGGAAGGGTCTGGAGTGGGTCTCATGGATTTCTGC
TCATGGTTCGTTTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAATGGCCTTATAAGTTTGACTACT
GGGGTCAGGGAACCCTGGTCACCGTCTCGAGC (SEQ ID NO: 712)

BMS3h-110
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGAGTGGGTCTATGAGTTGGGTCCGCCAGGCTCCAGGGAAGGGTCTAGAGTGGGTCTCACGGATTGGTAG
TAATGGTGCGGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATGGTTCCTAATTTGGTTT
TTGACTACTGGGGTCAGGGAACCCTGGTCACCGTCTCGAGC (SEQ ID NO: 713)

BMS3h-111
GAGGTGCAGCTGTTGGAGTCTGGGGGAGGCTTGGTACAGCCTGGGGGGTCCCTGCGTCTCTCCTGTGCAGCCTCCGGAT
TCACCTTTAATCGTTTTGATATGACGTGGGTCCGCCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGATCGTATTCCTAATCTTGTGT
TTGACTACTGGGGTCAGGGAACCCTGGTCACCGTCTCGAGC (SEQ ID NO: 714)

BMS3h-112
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGGAGAGTGATATGAAGTGGGTCCGCCAGGCTCCAGGGAAGGGTCTAGAGTGGGTCTCAAGTATTAGTCC
GAATGGTTGGGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATCCTTCTTCTCGTCTTAAGT
TTGACTACTGGGGTCAGGGAACCCTGGTCACCGTCTCGAGC (SEQ ID NO: 715)

BMS3h-139
GAGGTGCAGCTGTTGGAGTCTGGGGGAGGCTTGGTACAGCCTGGGGGGTCCCTGCGTCTCTCCTGTGCAGCCTCCGGAT
TCACCTTTGATAGTAGTGAGATGAGTTGGGTCCGCCAGGCTCCAGGGAAGGGTCTAGAGTGGGTCTCATCGATTGAGAA
TCAGGGTGGTGCGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGATCGTATTCCTAATCTTGTGT
TTGACTACTGGGGTCAGGGAACCCTGGTCACCGTCTCGAGC (SEQ ID NO: 716)

BMS3h-140
GAGGTGCAGCTGTTGGAGTCTGGGGGAGGCTTGGTACAGCCTGGGGGGTCCCTGCGTCTCTCCTGTGCAGCCTCCGGAT
TCACCCTTGATGCGTATCCTATGTATTGGGTCCGCCAGGCTCCAGGGAAGGGTCTAGAGTGGGTCTCATGGATTGCTTC
GGGTGGTGGTGCGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACGTACGAAGAATTTTGACTACT
GGGGTCAGGGAACCCTGGTCACCGTCTCGAGC (SEQ ID NO: 717)

BMS3h-141
GAGGTGCAGCTGTTGGAGTCTGGGGGAGGCTTGGTACAGCCTGGGGGGTCCCTGCGTCTCTCCTGTGCAGCCTCCGGAT
TCACCTTTATGAGTTATTCTATGGCTTGGGTCCGCCAGGCTCCAGGGAAGGGTCTAGAGTGGGTCTCAGGGATTACTTC
TAATGGTAATCGGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAATCGACTGGGGCTAATAGTAGGA
ATTTTGACTACTGGGGTCAGGGAACCCTGGTCACCGTCTCGAGC (SEQ ID NO: 718)

TABLE 4-continued

Human Anti-CD40 Variable Domain Encoding Nucleotide Sequences

BMS3h-142
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGGGGTATCTGATGTCGTGGGTCCGCCAGGCTCCAGGGAAGGGTCTAGAGTGGGTCTCAAGTATTGCGGC
TAATGGTATGCAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAAGCCGAGGGGTATTTGGGATG
GGGATTTTGACTACTGGGGTCAGGGAACCCTGGTCACCGTCTCGAGC (SEQ ID NO: 719)

BMS3h-143
GAGGTGCAGCTGTTGGAGTCTGGGGGAGGCTTGGTACAGCCTGGGGGGTCCCTGCGTCTCTCCTGTGCAGCCTCCGGAT
TCACCTTTCATGAGTCTACGATGACGTGGGTCCGCCAGGCTCCAGGGAAGGGTCTAGAGTGGGTCTCAACTATTCGGCA
TCCGGGTGAGTTTACATACTACGCAGACTCCGTGAAGGGCCGGTTCACCATCTCCCGCGACAATTCCAAGAACACGCTG
TATCTGCAAATGAACAGCCTGCGTGCCGGGGACACCGCGGTATATTACTGTGCGAAAGGGCTTATTCCTGATCTTCAGT
TTGACTACTGGGGTCAGGGAACCCTGGTCACCGTCTCGAGC (SEQ ID NO: 720)

BMS3h-144
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGATGTATAGTATGAGTTGGGTCCGCCAGGCTCCAGGGAAGGGTCTAGAGTGGGTCTCATCGATTGCGCC
GCCGGGTGGTAGGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACAGTCGCTGACGGGGTATAGTA
GGTCTTTTGACTACTGGGGTCAGGGAACCCTGGTCACCGTCTCGAGC (SEQ ID NO: 721)

BMS3h-145
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGCAGAATCCGATGTCGTGGGTCCGCCACGCTCCAGGGAAGGGTCTAGAGTGGGTCTCAACGATTCCTGC
GAATGGTCGTCCTACATCCTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAATATAGTCAGCAGCCGGGTCGTC
GGTTTGACTACTGGGGTCAGGGAACCCTGGTCACCGTCTCGAGC (SEQ ID NO: 722)

BMS3h-146
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTAATTATCATATGACGTGGGTCCGCCAGGCTCCAGGGAAGGGTCTAGAGTGGGTCTCATCGATTCCTGA
TAGTGGTAAGCAGACATACTACGCAGACTCCGTGAAGGGCCGGTTCACCATCTCCCGCGACAATTCCAAGAACACGCTG
TATCTACAAATGAACAGCCTGCGTGCCGAGGACACCGCGGTATATTACTGTGCGAAAGGTAGGATTCCGTCTCTTCTTT
TTGACTACTGGGGTCAGGGAACCCTGGTCACCGTCTCGAGC (SEQ ID NO: 723)

BMS3h-147
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGCAGTATCATATGCGTTGGGTCCGCCAGGCTCCAGGGAAGGGTCTAGAGTGGGTCTCAACGATTAATGA
TATTGGTAGTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGTTGGGGGGCGGGGAGTTTTT
CTTTTGACTACTGGGGTCAGGGAACCCTGGTCACCGTCTCGAGC (SEQ ID NO: 724)

BMS3h-148
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTTCGTATGATATGAAGTGGGTCCGCCAGGCTCCAGGGAAGGGTCTAGAGTGGGTCTCAACGATTAGTGC
GTCTGGTGTGTTTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACGGGAGCATGCGGGTCAGCCGC
CTTTTGACTACTGGGGTCAGGGAACCCTGGTCACCGTCTCGAGC (SEQ ID NO: 725)

BMS3h-149
GAGGTGCAGCTGTTGGAGTCTGGGGGAGGCTTGGTACAGCCTGGGGGGTCCCTGCGTCTCTCCTGTGCAGCCTCCGGAT
TCACCTTTAATGGTTATGCTATGAGTTGGGTCCGCCAGGCTCCAGGGAAGGGTCTAGAGTGGGTCTCAACTATTAATGC
TAATGGTAAGTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAAGTTGACTCTTGCTTCTAATT
ATTTTGACTACTGGGGTCAGGGAACCCTGGTCACCGTCTCGAGC (SEQ ID NO: 726)

BMS3h-150
GAGGTGCAGCTGTTGGAGTCTGGGGGAGGCTTGGTACAGCCTGGGGGGTCCCTGCGTCTCTCCTGTGCAGCCTCCGGAT
TCACCTTTATGGATTATATATGAAGTGGGTCCGCCAGGCTCCAGGGAAGGGTCTAGAGTGGGTCTCAAGTATTACTGC
GCTTGGTAAGAAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGATAGTGTTAAGTATCCTCTTA
ATCTTTTTGACTACTGGGGTCAGGGAACCCTGGTCACCGTCTCGAGC (SEQ ID NO: 727)

BMS3h-151
GAGGTGCAGCTGTTGGAGTCTGGGGGAGGCTTGGTACAGCCTGGGGGGTCCCTGCGTCTCTCCTGTGCAGCCTCCGGAT
TCACCTTTCCGCATTATACGATGGCGTGGGTCCGCCAGGCTCCAGGGAAGGGTCTGGAGTGGGTCTCATCTATTCAGTC
GCCTGGTTGGCGGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAATATGGGGATGGTCTTCCTTTGA
CTTTTGACTACTGGGGTCAGGGAACCCTGGTCACCGTCTCGAGC (SEQ ID NO: 728)

BMS3h-167
GAGGTGCAGCTGTTGGAGTCTGGGGGAGGCTTGGTACAGCCTGGGGGGTCCCTGCGTCTCTCCTGTGCAGCCTCCGGAT
TCACCTTTAGTGGTACGCCGATGTCTTGGGTCCGCCAGGCTCCAGGGAAGGGTCTAGAGTGGGTCTCACGTATTGGGGA
TGAGGGTCAGGAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGGTGACTCCGGATTTGACTT
TTGACTACTGGGGTCAGGGAACCCTGGTCACCGTCTCGAGC (SEQ ID NO: 729)

TABLE 4-continued

Human Anti-CD40 Variable Domain Encoding Nucleotide Sequences

BMS3h-168
GAGGTGCAGCTGTTGGAGTCTGGGGGAGGCTTGGTACAGCCTGGGGGGTCCCTGCGTCTCTCCTGTGCAGCCTCCGGAT
TCACCTTTAGTAGTAGTTCGATGTCTTGGGTCCGCCAGGCTCCAGGGAAGGGTCTAGAGTGGGTCTCAGCGATTGGGTC
TGATGGTCCGAGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCGTATTCCTACTCTTCATT
TTGACTACTGGGGTCAGGGAACCCTGGTCACCGTCTCGAGC (SEQ ID NO: 730)

BMS3h-169
GAGGTGCAGCTGTTGGAGTCTGGGGGAGGCTTGGTACAGCCTGGGGGGTCCCTGCGTCTCTCCTGTGCAGCCTCCGGAT
TCACCTTTAATCCTGGTGAGATGACGTGGGTCCGCCAGGCTCCAGGGAAGGGTCTAGAGTGGGTCTCAAGTATTGATGG
GTCTGGTTCTTCGACATACTACGCAGACTCCGTGAAGGGCCGGTTCACCATCTCCCGCGACAATTCCAAGAACACGCTG
TATCTGCAAATGAACAGCCTGCGTGCCGATGACACCGCGGTATATTACTGTGCGAAAGGGCGTATTCCTACTCTTCATT
TTGACTACTGGGGTCAGGGAACCCTGGTCACCGTCTCGAGC (SEQ ID NO: 731)

BMS3h-170
GAGGTGCAGCTGTTGGAGTCTGGGGGAGGCTTGGTACAGCCTGGGGGGTCCCTGCGTCTCTCCTGTGCAGCCTCCGGAT
TCACCTTTCCTGAGTCTATGATGGGGTGGGTCCGCCAGGCTCCAGGGAAGGGTCTAGAGTGGGTCTCATCGATTGGGTA
TCCTGGTGCTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGGTGGTAGTCGGGATGATAATT
TTGACTACTGGGGTCAGGGAACCCTGGTCACCGTCTCGAGC (SEQ ID NO: 732)

BMS3h-171
GAGGTGCAGCTGTTGGAGTCTGGGGGAGGCTTGGTACAGCCTGGGGGGTCCCTGCGCCTCTCCTGTGCAGCCTCCGGAT
TCACCTTTGGTCAGCATAGTATGCATTGGGTCCGCCAGGCTCCAGGGAAGGGTCTAGAGTGGGTCTCAAGTATTAGTGT
TCCGGGTCCGAAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAGTCTTAGGGATTTGCGTCCGG
GTGATAGTAAGAGTTTTGACTACTGGGGTCAGGGAACCCTGGTCACCGTCTCGAGC (SEQ ID NO: 733)

BMS3h-197
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTTCTGCTGCTATGGATTGGGTCCGCCAGGCTCCAGGGAAGGGTCTAGAGTGGGTCTCATCTATTAATGA
TATGGGTTCTAATACATACTACGCAGACTCCGTGAAGGCCCGGTTCACCATCTCCCGCGACAATTCCAAGAACACGCTG
TATCTGCAAATGAACAGCCTGCGTGCCGAGGACACCGCGGTATATTACTGTGCGAAACAGGGTGGTCGTTTTGACTACT
GGGGTCAGGGAACCCTGGTCACCGTCTCGAGC (SEQ ID NO: 734)

BMS3h-199
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTTATGATAGGATGGCTTGGGTCCGCCAGGCTCCAGGGAAGGGTCTAGAGTGGGTCTCATCGATTGATGG
TCCTGGTGGGGCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGGAAGGGAGGAGGGTTCCTGATTTTG
ACTACTGGGGTCAGGGAACCCTGGTCACCGTCTCGAGC (SEQ ID NO: 735)

BMS3h-200
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTGAGTATGAGATGACTTGGGTCCGCCAGGCTCCAGGGAAGGGTCTAGAGTGGGTCTCAAGGATTGATCC
GTTTGGTTCTGAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGGAAGGTGTGGTTCCTGATTTGAATT
TTGACTACTGGGGTCAGGGAACCCTGGTCACCGTCTCGAGC (SEQ ID NO: 736)

BMS3h-201
GAGGTGCAGCTGTTGGAGTCTGGGGGAGGCTTGGTACAGCCTGGGGGGTCCCTGCGTCTCTCCTGTGCAGCCTCCGGAT
TCACCTTTGATAAGTATGTTATGGGTGGGTCCGCCAGGCTCCAGGGAAGGGTCTAGAGTGGGTCTCAACTATTGGTAG
TTATGGTGGGGCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAGGCTTACTCTTAGTGCGACTA
AGTTTGACTACTGGGGTCAGGGAACCCTGGTCACCGTCTCGAGC (SEQ ID NO: 737)

BMS3h-203
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGGATTATGTGATGGGTTGGGTCCGCCAGGCTCCAGGGAAGGGTCTAGAGTGGGTCTCAACTATTGCGCA
TCGGGGTGATATTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACGTAGGCGTCTTAGTGATTATC
GGTTTGACTACTGGGGTCAGGGAACCCTGGTCACCGTCTCGAGC (SEQ ID NO: 738)

BMS3h-204
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGCAGTTTGATATGTATTGGGTCCGCCAGGCTCCAGGGAAGGGTCTAGAGTGGGTCTCAGCGATTAGTCC
GGCTGGTACTGGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGCGGGGATCGGTCTAGTCTTT
TTGACTACAGGGGTCAGGGAACCCTGGTCACCGTCTCGAGC (SEQ ID NO: 739)

BMS3h-205
GAGGTGCAGCTGTTGGAGTCTGGGGGAGGCTTGGTACAGCCTGGGGGGTCCCTGCGTCTCTCCTGTGCAGCCTCCGGAT
TCACCTTTAAGGATACGGGTATGACGTGGGTCCGCCAGGCTCCAGGGAAGGGTCTAGAGTGGGTCTCAAGTATTTCTAG
TTATGGTCGTGATACATACTACGCAGACTCCGTGAAGGGCCGGTTCACCATCTCCCGCGACAATTCCAAGAACACGCTG
TATCTGCAAATGAACAGCCTGCGTGCCGAGGACGCCGCGGTATATTACTGTGCGAAATTGAATGCGGCGCTGGGTTTTG
ACTACTGGGGTCAGGGAACCCTGGTCACCGTCTCGAGC (SEQ ID NO: 740)

TABLE 4-continued

Human Anti-CD40 Variable Domain Encoding Nucleotide Sequences

BMS3h-206
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTCCGTATCCGATGAGTTGGGTCCGCCAGGCTCCAGGGAAGGGTCTAGAGTGGGTCTCAGGTATTAATGC
GCCGGGTACGAGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGCAACAGATGTCTAGTGGGGTTTTTG
ACTACTGGGGTCAGGGAACCCTGGTCACCGTCTCGAGC (SEQ ID NO: 741)

BMS3h-207
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGAATCAGGATATGACTTGGGTCCGCCAGGCTCCAGGGAAGGGTCTAGAGTGGGTCTCAAGTATTGATAG
TTCTGGTCAGCTTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGTTAAGTCTCTTGCGCGGTTTG
ACTACTGGGGTCAGGGAACCCTGGTCACCGTCTCGAGC (SEQ ID NO: 742)

BMS3h-208
GAGGTGCAGCTGTTGGAGTCTGGGGGAGGCTTGGTACAGCCTGGGGGGTCCCTGCGTCTCTCCTGCGCAGCCTCCGGAT
TCACCTTTCCTGAGTCTGATATGAAGTGGGTCCGCCAGGCTCCAGGGAAGGGTCTAGAGTGGGTCTCAAGTATTAGTCC
GAATGGTTGGGATACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACCGGCTCAGGTTCTGTTTGACT
ACTGGGGTCAGGGAACCCTGGTCACCGTCTCGAGC (SEQ ID NO: 743)

BMS3h-209
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGCAGTATGTGATGGGTTGGGTCCGCCAGGCTCCAGGGAAGGGTCTAGAGTGGGTCTCAACGATTGGTAC
GTCGGGTAAGTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGCAACGTAGGTCTCTGACTCGGGTTC
ATTTTGACTACTGGGGTCAGGGAACCCTGGTCACCGTCTCGAGC (SEQ ID NO: 744)

BMS3h-210
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTGTGGAGCATATGAGTTGGGTCCGCCAGGCTCCAGGGAAGGGTCTAGAGTGGGTCTCAGCGATTACGGG
TGATGGTGATCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAACGGTTTCGTGGAATGGTCGTT
TTGACTACTGGGGTCAGGGAACCCTGGTCACCGTCTCGAGC (SEQ ID NO: 745)

BMS3h-211
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGTGGTATAATATGGGTTGGGTCCGCCAGGCTCCAGGGAAGGGTCTGGAGTGGGTCTCAAGGATTGCTCC
GTCTGGTATTATTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGTTGCGTGGTAAGTTTGACT
ACTGGGGTCAGGGAACCCTGGTCACCGTCTCGAGC (SEQ ID NO: 746)

BMS3h-212
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGAATTATGAGATGAGGTGGGTCCGCCAGGCTCCAGGGAAGGGTCTAGAGTGGGTCTCATCTATTTCTTC
GGCTGGTACTGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACAGTCGCTTAATTTTGACTACT
GGGGTCAGGGAACCCTGGTCACCGTCTCGAGC (SEQ ID NO: 747)

BMS3h-213
GAGGTGCAGCTGTTGGAGTCTGGGGGAGGCTTGGTACAGCCTGGGGGGTCCCTGCGTCTCTCCTGTGTAGCCTCCGGAT
TCACCTTTGATGAGGAGCCGATGACTTGGGTCCGCCAGGCTCCAGGGAAGGGTCTAGAGTGGGTCTCAATTATTGATCC
GGGTGGTGGGCGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATCTAATAGTATGTTTGACTACT
GGGGTCAGGGAACCCTGGTCACCGTCTCGAGC (SEQ ID NO: 748)

BMS3h-214
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTGCGTATCCTATGCATTGGGTCCGCCAGGCTCCAGGGAAGGGTCTAGAGTGGGTCTCATCTATTGCTTC
TTCGGGTATTACGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATTTACTCGGCTGCATTTTCCTG
CGCAGTTTGACTACTGGGGTCAGGGAACCCTGGTCACCGTCTCGAGC (SEQ ID NO: 749)

BMS3h-215
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGATTATGCGATGGGTTGGGTCCGCCAGGCTCCAGGGAAGGGTCTAGAGTGGGTCTCAAGGATTTCTCC
TGAGGGTTCTAGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATTGCGGCCGTATGCGTCGAAGT
TTGACTACTGGGGTCAGGGAACCCTGGTCACCGTCTCGAGC (SEQ ID NO: 750)

BMS3h-230
GAGGTGCAGCTGTTGGAGTCTGGGGGAGGCTTGGTACAGCCTGGGGGGTCCCTGCGTCTCTCCTGTGCAGCCTCCGGAT
TCACCTTTAGGCCGTATGATATGGTTGGGTCCGCCAGGCTCCAGGGAAGGGTCTAGAGTGGGTCTCAACGATTTCTCA
TCAGGGTAATCGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGTGTCTCATCATTTTGACTACT
GGGGTCAGGGAACCCTGGTCACCGTCTCGAGC (SEQ ID NO: 751)

TABLE 4-continued

Human Anti-CD40 Variable Domain Encoding Nucleotide Sequences

BMS3h-231
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTGCGTATAATATGTGGTGGGCCCGCCAGGCTCCAGGGAAGGGTTTAGAGTGGGTCTCATGGATTAATTC
GACTGGTTCTCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAAATTGGCATCGGGGGAGGTTTG
ACTACTGGGGTCAGGGAACCCTGGTCACCGTCTCGAGC (SEQ ID NO: 752)

BMS3h-232
GAGGTGCAGCTGTTGGAGTCTGGGGGAGGCTTGGTACAGCCTGGGGGTCCCTGCGTCTCTCCTGTGCAGCCTCCGGAT
TCACCTTTGATAGGTATCGGATGGGGTGGGTCCGCCAGGCTCCAGGGAAGGGTCTAGAGTGGGTCTCAACGATTAATCG
GCTGGGTCAGAGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGTGAAGAAGCATAAGTTTGACT
ACTGGGGTCAGGGAACCCTGGTCACCGTCTCGAGC (SEQ ID NO: 753)

BMS3h-233
GAGGTGCAGCTGTTGGAGTCTGGGGGAGGCTTGGTACAGCCTGGGGGTCCCTGCGTCTCTCCTGTGCAGCCTCCGGAT
TCACCTTTGCGCATTATAATATGCGGTGGGTCCGCCAGGCTCCAGGGAAGGGTCTAGAGTGGGTCTCAACGATTACGAA
GACTGGTTTTCGTACATACTACGCAGACTCCGTGAAGGGCCGGTTCACCATCTCCCGTGACAATTCCAAGAACACGCTG
TATCTGCAAATGAACAGCCTGCGTGCCGAGGACACCGCGGTATATTACTGTGCGAAAGCGGGGCAGTTTGATTTTGACT
ACTGGGGTCAGGGAACCCTGGTCACCGTCTCGAGC (SEQ ID NO: 754)

BMS3h-234
GAGGTGCAGCTGTTGGAGTCTGGGGGAGGCTTAGTACAGCCTGGGGGGTCCCTGCGTCTCTCCTGTGCAGCCTCCGGAT
TCACCTTTTATCCTTATAGTATGCATTGGGTCCGCCAGGCTCCAGGGAAGGGTCTGGAGTGGGTCTCAACTATTGATGG
TAGTGGTATGTTTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGGAAGATTCTCTGAAGGCTTCTTTTG
ACTACTGGGGTCAGGGAACCCTGGTCACCGTCTCGAGC (SEQ ID NO: 755)

BMS3h-235
GAGGTGCAGCTGTTGGAGTCTGGGGGAGGCTTGGTACAGCCTGGGGGTCCCTGCGTCTCTCCTGTGCAGCCTCCGGAT
TCACCTTTCCGCTTTATGGGATGTGGTGGGTCCGCCAGGCTCCAGGGAAGGGTCTAGAGTGGGTCTCATATATTGGGCC
TTATGGTCATACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAAAGCGGAAGAAGAAGTTTGACT
ACTGGGGTCAGGGAACCCTGGTCACCGTCTCGAGC (SEQ ID NO: 756)

BMS3h-236
GAGGTGCAGCTGTTGGAGTCTGGGGGAGGCTTGGTACAGCCTGGGGGTCCCTGCGTCTCTCCTGTGCAGCCTCCGGAT
TCACCTTTCCTAGGTATCGGATGAGTTGGGTCCGCCAGGCTCCAGGGAAGGGTCTAGAGTGGGTCTCAAGTATTACTCC
GTATGGTGCTCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATATGGTAAGTGGTATTTTGACT
ACTGGGGTCAGGGAACCCTGGTCACCGTCTCGAGC (SEQ ID NO: 757)

BMS3h-237
GAGGTGCAGCTGTTGGAGTCTGGGGGAGGCTTGGTACAGCCTGGGGGGTCCCTGCGTCTCTCCTGTGCAGCCTCCGGAT
TCACCTTTAATGAGTATGCGATGAGGTGGGTCCGCCAGGCTCCAGGGAAGGGTCTAGAGTGGGTCTCAACGATTGATCG
TCTGGGTCTTCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAGTGGGCCTTTTACGTTTGACT
ACTGGGGTCAGGGAACCCTGGTCACCGTCTCGAGC (SEQ ID NO: 758)

BMS3h-238
GAGGTGCAGCTGTTGGAGTCTGGGGGAGGCTTGGTACAGCCTGGGGGTCCCTGCGTCTCTCCTGTGCAGCCTCCGGAT
TCACCTTTGAGCGGTATAATATGCGTTGGGTCCGCCAGGCTCCAGGGAAGGGTCTAGAGTGGGTCTCAACGATTGATCG
GCTGGGTCTTGCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGCGGGTTCGTGGTCTTTTGACT
ACTGGGGTCAGGGAACCCTGGTCACCGTCTCGAGC (SEQ ID NO: 759)

BMS3h-239
GAGGTGCAGCTGTTGGAGTCTGGGGGAGGCTTGGTACAGCCTGGGGGTCCCTGCGTCTCTCCTGTGCAGCCTCCGGAT
TCACCTTTGGTATTTATGATATGAAGTGGGTCCGCCAGGCTCCAGGGAAGGGTCTAGAGTGGGTCTCAACGATTTCGTC
GTCGGGTACTCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATATCCTCAGCCTTATCCTTTTG
ACTACTGGGGTCAGGGAACCCTGGTCACCGTCTCGAGC (SEQ ID NO: 760)

BMS3h-240
GAGGTGCAGCTATTGGAGTCTGGGGGAGGCTTGGTACAGCCTGGGGGGTCCCTGCGTCTCTCCTGTGCAGCCTCCGGAT
TCACCTTTTGGGTGTATGATATGCGTTGGGTCCGCCAGGCTCCAGGGAAGGGTCTAGAGTGGGTCTCAACGATTTCTGC
GACTGGTGTGCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATATCCGCCTGCTGGTCGGTTTG
ACTACTGGGGTCAGGGAACCCTGGTCACCGTCTCGAGC (SEQ ID NO: 761)

BMS3h-241
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGACTTATGATATGATTTGGGTCCGCCAGGCTCCAGGGAAGGGTCTAGAGTGGGTCTCAGCTATTTCTCC
TAATGGTACTGGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACCTCCGCAGGTGAATACTGAGT
TTGACTACCGGGGTCAGGGAACCCTGGTCACCGTCTCGAGC (SEQ ID NO: 762)

TABLE 4-continued

Human Anti-CD40 Variable Domain Encoding Nucleotide Sequences

BMS3h-243
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGAAGGAGGATATGGGGTGGGTCCGCCAGGCTCCAGGGAAGGGTCTAGAGTGGGTCTCACATATTTCGCC
GAATGGTTATGCGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAGTTGGTCTAGTTTTGACTACT
GGGGTCAGGGAACCCTGGTCACCGTCTCGAGC (SEQ ID NO: 763)

BMS3h-244
GAGGTGCAGCTGTTGGAGTCTGGGGGAGGCTTGGTACAGCCTGGGGGGTCCCTGCGTCTCTCCTGTGCAGCCTCCGGAT
TCACCTTTAGTGCTACTCCGATGGAGTGGGCCCGCCAGGCTCCAGGGAAGGGTCTAGAGTGGGTCTCAACTATTTCTGA
GAGTGGTTATAGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATGGAATTCGACTACTGGTTTTG
ACTACTGGGGTCAGGGAACCCTGGTCACCGTCTCGAGC (SEQ ID NO: 764)

BMS3h-245
GAGGTGCAGCTGTTGGAGTCTGGGGGAGGCTTGGTACAGCCTGGGGGGTCCCTGCGTCTCTCCTGTGCAGCCTCCGGAT
TCACCTTTAATACGGTGGATATGGAGTGGGTCCGCCAGGCTCCAGGGAAGGGTCTAGAGTGGGTCTCAAGTATTAGTCC
GAATGGTTGGGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGGAAGCTCCGCATCGGGCGTTTGACT
ACTGGGGTCAGGGAACCCTGGTCACCGTCTCGAGC (SEQ ID NO: 765)

BMS3h-246
GAGGTGCAGCTGTTGGAGTCTGGGGGGGGCTTGGTACAGCCTGGGGGGTCCCTGCGTCTCTCCTGTGCAGCCTCCGGAT
TCACCTTTGAGGATAAGGAGATGAGTTGGGTCCGCCAGGCTCCAGGGAAGGGTCTAGAGTGGGTCTCACGGATTGATGC
TTTGGGTGATTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGGAAGGGATGGTTCCTCGTCTGAAGT
TTGACTACTGGGGTCAGGGAACCCTGGTCACCGTCTCGAGC (SEQ ID NO: 766)

BMS3h-247
GAGGTGCAGCTGTTGGAGTCTGGGGGAGGCTTGGTACAGCCTGGGGGGTCCCTGCGTCTCTCCTGTGCAGCCTCCGGAT
TCACCTTTAGTGATCATTCGATGATGTGGGTCCGCCAGGCTCCAGGGAAGGGTCTAGAGTGGGTCTCAGATATTGAGCC
GCATGGTGTTCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAATCCTACTTTTGACTACTGGGGTC
AGGGAACCCTGGTCACCGTCTCGAGC (SEQ ID NO: 767)

BMS3h-248
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGCCGCATACTATGCATTGGGTCCGCCAGGCTCCAGGGAAGGGTCTAGAGTGGGTCTCAGGTATTGGTCC
GGATGGTACTACTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACGTTCGTATAGTTGGGATCGTG
GGTGGACGTTTGACTACTGGGGTCAGGGAACCCTGGTCACCGTCTCGAGC (SEQ ID NO: 768)

BMS3h-249
GAGGTGCAGCTGTTGGAGTCTGGGGGAGGCTTGGTACAGCCTGGGGGGTCCCTGCGTCTCTCCTGTGCAGCCTCCGGAT
TCACCTTTTATGCTTCGGATATGAAGTGGGTCCGCCAGGCTCCAGGGAAGGGTCTAGAGTGGGTCTCAAGTATTAGTCC
GAATGGTTGGGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGCTGATTATACTTATCATTCTT
TTGACTACTGGGGTCAGGGGACCCTGGTCACCGTCTCGAGC (SEQ ID NO: 769)

BMS3h-250
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGCATTATAATATGCGGTGGGTCCGCCAGGCTCCAGGGAAGGGTCTAGAGTGGGTCTCAACGATTACGAA
GACTGGTTTTCGTACATACTACGCAGACTCCGTGAAGGGCCGGTTCACCATCTCCCGTGACAATTCCAAGAACACGCTG
TATCTGCAAATGAACAGCCTGCGTGCCGAGGACACCGCGGTATATTACTGTGCGAAAGCGGGGCAGTTTGATTTTGACT
ACTGGGGTCAGGGAACCCTGGTCACCGTCTCGAGC (SEQ ID NO: 770)

BMS3h-251
GAGGTGCAGCTGTTGGAGTCTGGGGGAGGCTTGGTACAGCCTGGGGGGTCCCTGCGTCTCTCCTGTGCAGCCTCCGGAT
TCACCTTTTCGCATTATCATATGGGTTGGGCCCGCCAGGCTCCAGGGAAGGGTCTAGAGTGGGTCTCAGTTATTGGGCC
GAGGGGTATTTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATCGCCTTCGCGTCATAGGTTTG
ACTACTGGGGTCAGGGAACCCTGGTCACCGTCTCGAGC (SEQ ID NO: 771)

BMS3h-252
GAGGTGCAGCTGTTGGAGTCTGGGGGAGGCTTGGTACAGCCTGGGGGGTCCCTGCGTCTCTCCTGTGCAGCCTCCGGAT
TCACCTTTAATGAGTATGCGATGAGGTGGGTCCGCCAGGCTCCAGGGAAGGGTCTAGAGTGGGTCTCAACGATTGATCG
TCTGGGTCTTCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAGTGGGCCTTTTACGTTTGACT
ACTGGGGTCAGGGAACCCTGGTCACCGTCTCGAGC (SEQ ID NO: 772)

BMS3h-253
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTAATTATAGTATGAAGTGGGCCCGCCAGGCTCCAGGGAAGGGTCTAGAGTGGGTCTCAACTATTACTCC
TGATGGTTGGTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGTGGGGATGCTGTTTGGGGGT
GGATTGGTGGGTTTGACTACTGGGGTCAGGGAACCCTGGTCACCGTCTCGAGC (SEQ ID NO: 773)

TABLE 4-continued

Human Anti-CD40 Variable Domain Encoding Nucleotide Sequences

BMS3h-254
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGGATTATGGTATGAAGTGGGTCCGCCAGGCTCCAGGGAAGGGTCTAGAGTGGGTCTCAGCTATTACGTC
TAATGGTGATTTTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATCTTTGTATAAGTTTGACTACT
GGGGTCAGGGAACCCTGGTCACCGTCTCGAGC (SEQ ID NO: 774)

BMS3h-255
GAGGTGCAGCTGTTGGAGTCTGGGGGAGGCTTGGTACAGCCTGGGGGGTCCCTGCGTCTCTCCTGTGCAGGCTCCGGAT
TCACCTTTCCTACTTATAAGATGGGGTGGGTCCGCCAGGCTCCAGGGAAGGGTCTAGAGTGGGTCTCATTTATTGATTA
TTGGGGTTGGCGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAGTCCGTATTCTTGGACTCATG
ATAGTCCTCATTTTGACTACTGGGGTCAGGGAACCCTGGTCACCGTCTCGAGC (SEQ ID NO: 775)

BMS3h-256
GAGGTGCAGCTGTTGGAGTCTGGGGGAGGCTTGGTACAGCCTGGGGGGTCCCTGCGTCTCTCCTGTGCAGCCTCCGGAT
TCACCTTTAGGCCTTATACGATGTGTTGGGCCCGCCAGGCTCCAGGGAAGGGTCTAGAGTGGGTCTCATGTATTAGTGA
TGCTGGTTCTTTTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAAGGATGTCTTCTTTTGACTACT
GGGGTCAGGGAACCCTGGTCACCGTCTCGAGC (SEQ ID NO: 776)

BMS3h-257
GAGGTGCAGCTGTTGGAGTCTGGGGGAGGCTTGGTACAGCCTGGGGGGTCCCTGCGTCTCTCCTGTGCAGCCTCCGGAT
TCACCTTTCAGAATTATCAGATGGCTTGGGTCCGCCAGGCTCCAGGGAAGGGTCTAGAGTGGGTCTCAACTATTAGTGG
GACTGGTAAGAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAACTCCTCAGAATTATTTTAGTG
TGCGTCGGTTTGACTACTGGGGTCAGGGAACCCTGGTCACCGTCTCGAGC (SEQ ID NO: 777)

BMS3h-258
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGGCGTATACTATGGGGTGGGTCCGCCAGGCTCCAGGGAAGGGTCTAGAGTGGGTCTCAAAGATTTCGAC
GTCTGGTGGGCAGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACCTTTGAATTGGTGGGCGTTTG
ACTACTGGGGTCAGGGAACCCTGGTCACCGTCTCGAGC (SEQ ID NO: 778)

BMS3h-272
GAGGTGCAGCTGTTGGAGTCTGGGGGAGGCTTGGTACAGCCTGGGGGGTCCCTGCGTCTCTCCTGTGCAGCCTCCGGAT
TCACCTTTAATGCGTATCCTATGACTTGGGTCCGCCAGGCTCCAGGGAAGGGTCTAGAGTGGGTCTCACGGATTGATGG
TTATGGTCGGCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATTATTCCTAATTTTGACT
ACTGGGGTCAGGGAACCCTGGTCACCGTCTCGAGC (SEQ ID NO: 779)

BMS3h-273
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGGCGGTTGATATGACGTGGGTCCGCCAGGCTCCAGGGAAGGGTCTAGAGTGGGTCTCAGCGATTTCGCC
TAGTGGTTCTGCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGCGTGTGCCGGATCTTGGTT
TTGACTACTGGGGTCAGGGAACCCTGGTCACCGTCTCGAGC (SEQ ID NO: 780)

BMS3h-274
GAGGTGCAGCTGTTGGAGTCTGGGGGAGGCTTGGTACAGCCTGGGGGGTCCCTGCGTCTCTCCTGTGCAGCCTCCGGAT
TCACCTTTGATAGTTATGCGATGGGGTGGGCCCGCCAGGCTCCAGGGAAGGGTCTAGAGTGGGTCTCAGCTATTGGGGC
TAAGGGTTTGTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGCGGCTAGGGGTAAGTTTGACT
ACTGGGGTCAGGGAACCCTGGTCACCGTCTCGAGC (SEQ ID NO: 781)

BMS3h-275
GAGGTGCAGCTGTTGGAGTCTGGGGGAGGCTTGGTACAGCCTGGGGGGTCCCTGCGTCTCTCCTGTGCAGCCTCCGGAT
TCACCTTTACTCGGTATCAGATGGGTTGGGTCCGCCAGGCTCCAGGGAAGGGTCTAGAGTGGGTCTCAGTTATTAATGT
TTGGGGTTCGAGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAATGTCTGGGAAGTTTGCCTACT
GGGGTCAGGGAACCCTGGTCACCGTCTCGAGC (SEQ ID NO: 782)

BMS3h-276
GAGGTGCAGCTGTTGGAGTCTGGGGGAGGCTTGGTACAGCCTGGGGGGTCCCTGCGTCTTTCCTGTGCAGCCTCCGGAT
TCACCTTTGGGAATTATAGTATGATGTGGGTCCGCCAGGCTCCAGGGAAGGGTCTAGAGTGGGTCTCAACGATTATTCC
TGCTGGTACGTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACCGTCGATTAGGTTGTTTGACT
ACTGGGGTCAGGGAACCCTGGTCACCGTCTCGAGC (SEQ ID NO: 783)

BMS3h-279
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTGCGTATGATATGGGGTGGGTCCGCCAGGCTCCAGGGAAGGGTCTAGAGTGGGTCTCATGGATTTCTCC
GAATGGTTATGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGGGTGTGAAGTTTGACTACT
GGGGTCAGGGAACCCTGGTCACCGTCTCGAGC (SEQ ID NO: 784)

TABLE 4-continued

Human Anti-CD40 Variable Domain Encoding Nucleotide Sequences

BMS3h-282
GAGGTGCAGCTGTTGGAGTCTGGGGGAGGCTTGGTACAGCCTGGGGGGTCCCTGCGTCTCTCCTGTGCAGCCTCCGGAT
TCACCTTTGTTTGGTATGAGATGGCTTGGGTCCGCCAGGCTCCAGGGAAGGGTCTAGAGTGGGTCTCAACGATTCAGGC
TGATGGTGAGCAGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGCTTCGTATGCTCTTGTGTATC
CTCCTGAGGAGTTTGACTACTGGGGTCAGGGAACCCTGGTCACCGTCTCGAGC (SEQ ID NO: 785)

BMS3h-287
GAGGTGCAGCTGTTGGAGTCTGGGGGAGGCTTGGTACAGCCTGGGGGGTCCCTGCGTCTCTCCTGTGCAGCCTCCGGAT
TCACCTTTACGAATTATAGGATGTCTTGGGTCCGCCAGGCTCCAGGGAAGGGTCTAGAGTGGGTCTCAGCTATTGATGA
TCTGGGTGTGTCGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATGGAGGCTTAAGAATAGTCAGC
CGACGGATTTTGACTACTGGGGTCAGGGAACCCTGGTCACCGTCTCGAGC (SEQ ID NO: 786)

BMS3h-292
GAGGTGCAGCTGTTGGAGTCTGGGGGAGGCTTGGTACAGCCTGGGGGGTCCCTGCGTCTCTCCTGTGCAGCCTCCGGAT
TCACCTTTGATCAGGCTCATATGTGGTGGGTCCGCCAGGCTCCAGGGAAGGGTCTAGAGTGGGTCTCATTTATTAATCC
TTCGGGTTATTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACCTTCGCTTAGTCCGTCTTCTT
TTGACTACTGGGGTCAGGGAACCCTGGTCACCGTCTCGAGC (SEQ ID NO: 787)

BMS3h-293
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGACTGGTCAGATGGGTTGGGCCCGCCAGGCTCCAGGGAAGGGTCTAGAGTGGGTCTCAAATATTGATGG
GTCTGGTACGTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAAGTACGCAGAATTATCGGTTTG
ACTACTGGGGTCAGGGAACCCTGGTCACCGTCTCGAGC (SEQ ID NO: 788)

BMS3h-296
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTGCTTATCCGATGTATTGGGTCCGCCAGGCTCCAGGGAAGGGTCTAGAGTGGGTCTCATCTATTCATAA
GGATGGTAGGATTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACAGGGTACGCCGGTTGATGGGT
TTGACTACTGGGGTCAGGGAACCCTGGTCACCGTCTCGAGC (SEQ ID NO: 789)

BMS3h-297
GAGGTGCAGCTGTTGGAGTCTGGGGGAGGCTTGGTACAGCCTGGGGGGTCCCTGCGTCTCTCCTGTGCAGCCTCCGGAT
TCACCTTTCCTGATGAGGGTATGACGTGGGTCCGCCAGGCTCCAGGGAAGGGTCTAGAGTGGGTCTCAACGATTGAGAC
TGGTGGTACGGTGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAATGGATGGGTCTGGTACATGGC
AGACGTTTGACTACTGGGGTCAGGGAACCCTGGTCACCGTCTCGAGC (SEQ ID NO: 790)

BMS3h-298
GAGGTGCAGCTGTTGGAGTCTGGGGGAGGCTTGGTACAGCCTGGGGGGTCCCTGCGTCTCTCCTGTGCAGCCTCCGGAT
TCACCTTTGATAGTCTGGGTATGGGTTGGGCCCGCCAGGCTCCAGGGAAGGGTCTAGAGTGGGTCTCATATATTCGGGC
TGAGGGTGCTTATACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAATATCTTGCGGATTCTGACTACT
GGGGTCAGGGAACCCTGGTCACCGTCTCGAGC (SEQ ID NO: 791)

BMS3h-299
GAGGTGCAGCTGTTGGAATCTGGGGGAGGCTTGGTACAGCCTGGGGGGTCCCTGCGTCTCTCCTGTGCAGCCTCCGGAT
TCACCTTTAGTGAGTCGTATATGGAGTGGGTCCGCCAGGCTCCAGGGAAGGGTCTAGAGTGGGTCTCAGGTATTGATCA
TATTGGTGGTGGGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGATGATGGTCGTGGTGGGTCTA
TGTTTGACTACTGGGGTCAGGGAACCCTGGTCACCGTCTCGAGC (SEQ ID NO: 792)

BMS3h-300
GAGGTGCAGCTGTTGGAGTCTGGGGGAGGCTTGGTACAGCCTGGGGGGTCCCTGCGTCTCTCCTGTGCAGCCTCCGGAT
TCACCTTTTCTGGTGGGTATATGTGGTGGGTCCGCCAGGCTCCAGGGAAGGGTCTAGAGTGGGTCTCAAGTATTGGGGC
TAGTGGTGCGTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAACGGGGGGTAGGTTAGACTACT
GGGGTCAGGGAACCCTGGTCACCGTCTCGAGC (SEQ ID NO: 793)

BMS3h-301
GAGGTGCAGCTGTTGGAGTCTGGGGGAGGCTTGGTACAGCCTGGGGGGTCCCTGCGTCTCTCCTGTGCAGCCTCCGGAT
TCACCTTTGATGAGGGCATATGGGTGGGTCCGCCAGGCTCCAGGGAAGGATCTAGAGTGGGTCTCATATATTGGGAG
TCTGGGTTTGCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACGGGAGTTTAGTAATGGGGGT
TTGACTACTGGGGTCAGGGAACCCTGGTCACCGTCTCGAGC (SEQ ID NO: 794)

BMS3h-302
GAGGTGCAGCTGTTGGAGTCTGGGGGAGGCTTGGTACAGCCTGGGGGGTCCCTGCGTCTCTCCTGTGCAGCCTCCGGAT
TCACCTTTAAGACTAGTCCTATGTATTGGGTCCGCCAGGCTCCAGGGAAGGGTCTAGAGTGGGTCTCATCGATTGATCG
GACTGGTGGCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACAGGCTCTGCTTACTGATGCGA
AGCGTTTTGACTACTGGGGTCAGGGAACCCTGGTCACCGTCTCGAGC (SEQ ID NO: 795)

TABLE 4-continued

Human Anti-CD40 Variable Domain Encoding Nucleotide Sequences

BMS3h-303
GAGGTGCAGCTGTTGGAGTCTGGGGGAGGCTTGGTACAGCCTGGGGGGTCCCTGCGTCTCTCCTGTGCAGCCTCCGGAT
TCACCTTTGATGGTCGGGATATGGTTTGGGTCCGCCAGGCTCCAGGGAAGGGTCTAGAGTGGGTCTCAGCTATTAGTCC
GAGTGGTCTGGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGGAACGTCCTCAGATGCTGGTTACTA
ATTTTGACTACTGGGGTCAGGGAACCCTGGTCACCGTCTCGAGC (SEQ ID NO: 796)

BMS3h-304
GAGGTGCAGCTGTTGGAGTCTGGGGGAGGCTTGGTACAGCCTGGGGGGTCCCTGCGTCTCTCCTGTGCAGCCTCCGGAT
TCACCTTTGGTAATGATCCGATGAGTTGGGTCCGCCAGGCTCCAGGGAAGGGTCTAGAGTGGGTCTCAGGGATTGGTCG
GGAGGGTGATTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGATTCTATGCGGCATCAGCCGT
TTGACTACTGGGGTCAGGGAACCCTGGTCACCGTCTCGAGC (SEQ ID NO: 797)

BMS3h-305
GAGGTGCAGCTGTTGGAGTCTGGGGGAGGCTTGGTACAGCCTGGGGGGTCCCTGCGTCTCTCCTGTGCAGCCTCCGGAT
TCACCTTTGATGAGACTTATATGAAGTGGGTCCGCCAGGCTCCAGGGAAGGGTCTAGAGTGGGTCTCAGCGATTGGGGC
GTCGGGTGCTGATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATTTACGCATCTGAATGGTCGGT
TTGACTACTGGGGTCAGGGAACCCTGGTCACCGTCTCGAGC (SEQ ID NO: 798)

BMS3h-306
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGGGTGGCCTATGGGGTGGGTCCGCCAGGCTCCAGGGAAGGGTCTAGAGTGGGTCTCAGGTATTGATAT
TGATGGTGCTCCGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGGAGGCGGGTTCTTGGTCTT
TTGACTACTGGGGTCAGGGAACCCTGGTCACCGTCTCGAGC (SEQ ID NO: 799)

BMS3h-307
GAGGTGCAGCTGTTGGAGTCTGGGGGAGGCTTGGTACAGCCTGGGGGGTCCCTGCGTCTCTCCTGTGCAGCCTCCGGAT
TCACCTTTAGTGATCAGGCGATGTGGTGGGCCCGCCAGGCTCCAGGGAAGGGTCTAGAGTGGGTCTCATTTATTCAGGG
TGATGGTGGTTTTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACCTAGTAAGCCGTTTGACTACT
GGGGTCAGGGAACCCTGGTCACCGTCTCGAGC (SEQ ID NO: 800)

BMS3h-308
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGACTGGTCAGATGGGTTGGGCCCGCCAGGCTCCAGGGAAGGGTCTAGAGTGGGTCTCAAATATTGATGG
GTCTGGTACGTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGCGGTGCGGAATTTTGCTTTTG
ACTACTGGGGTCAGGGAACCCTGGTCACCGTCTCGAGC (SEQ ID NO: 801)

BMS3h-309
GAGGTGCAGCTGTTGGAGTCTGGGGGAGGCTTGGTACAGCCTGGGGGGTCCCTGCGTCTCTCCTGTGCAGCCTCCGGAT
TCACCTTTAGTGGGCATGATATGTCTTGGGTCCGCCAGGCTCCAGGGAAGGGTCTAGAGTGGGTCTCAGCTATTAGTCC
TCATGGTACGCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGGGATTAGGGGTTGGATTGGTC
ATGATACGCAGCCTTTTGACTACTGGGGTCAGGGAACCCTGGTCACCGTCTCGAGC (SEQ ID NO: 802)

BMS3h-310
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGAGTAAGGATATGCTTTGGGTCCGCCAGGCTCCAGGGAAGGGTCTAGAGTGGGTCTCATCTATTTCGTC
GGATGGTACTCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGCAAGAGCTGGGTGGGTCTTGGCAGT
TTGACTACTGGGGTCAGGGAACCCTGGTCACCGTCTCGAGC (SEQ ID NO: 803)

BMS3h-311
GAGGTGCAGCTGTTGGAGTCTGGGGGAGGCTTGGTACAGCCTGGGGGGTCCCTGCGTCTCTCCTGTGCAGCCTCCGGAT
TCACCTTTGCGGATCGTGATATGGTTTGGGTCCGCCAGGCTCCAGGGAAGGGTCTAGAGTGGGTCTCAGGTATTGGGGC
GTCGGGTACGTCTACATACTACGCAGACTCCGTGAAGGGCCGGTTCACCATCTCCCGCGACAATTCCAAGAACACGCTG
TATCTGCAAATGAACAGCCTGCGTGCCGAGGACGCCGCGGTATATTACTGTGCGAAAGGTGGGACGGGTCCTACTGATT
TGTGGGATTTTGACTACTGGGGTCAGGGAACCCTGGTCACCGTCTCGAGC (SEQ ID NO: 804)

BMS3h-312
GAGGTGCAGCTGTTGGAGTCTGGGGGAGGCTTGGTACAGCCTGGGGGGTCCCTGCGTCTCTCCTGTGCAGCCTCCGGAT
TCACCTTTGATGATGAGAAGATGCTTTGGGTCCGCCAGGCTCCAGGGAAGGGTCTAGAGTGGGTCTCAAGTATTAGTGT
GAGTGGTCTGCATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGGAGGCGGGTTCTTGGTCTT
TTGACTACTGGGGTCAGGGAACCCTGGTCACCGTCTCGAGC (SEQ ID NO: 805)

BMS3h-313
GAGGTGCAGCTGTTGGAGTCCGGGGGAGGCTTGGTACAGCCTGGGGGGTCCCTGCGTCTCTCCTGTGCAGCCTCCGGAT
TCACCTTTGGGCAGGAGAGGATGATTTGGGTCCGCCAGGCTCCTGGGAAGGGTCTAGAGTGGGTCTCAGATATTTCGGC
TTCGGGTGGGACTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGGAGGCGGGTTCTTGGTCTT
TTGACTACTGGGGTCAGGGAACCCTGGTCACCGTCTCGAGC (SEQ ID NO: 806)

TABLE 4-continued

Human Anti-CD40 Variable Domain Encoding Nucleotide Sequences

BMS3h-37-1
GAGGTGCAGCTGTTGGAGTCTGGGGGAGGCTTGGTACAGCCTGGGGGGTCTCTGCGTCTCTCCTGTGCAGCCTCCGGAT
TCACCTTTGAGTGGTATGAGATGCAGTGGGTCCGCCAGGCTCCAGGGAAGGGTCTAGAGTGGGTCTCAGCGATTTCTGG
TGATGGTTATCGTACATACTACGCAGACTCCGTGAAAGGCCGGTTCACCATCTCCCGCGACAATTCCATGAACACGCTG
TATCTGCAAATGAACAGCCTGCGTGCCGAGGACACCGCGGTATATTACTGTGCGAAAGAGCTTGGGTATTTTGACTACA
GGGGTCGGGGAACCCTGGTCACCGTCTCGAGC (SEQ ID NO: 807)

BMS3h-37-2
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACT
GGGGTCGGGGAACCCTGGTCACCGTCTCGAGC (SEQ ID NO: 808)

BMS3h-37-3
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGTCTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACC
GGGGTTCAGGGAACCCTGGTCACCGTCTCGAGC (SEQ ID NO: 809)

BMS3h-37-4
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCAAGGCTCCAGGGAAGGGTCTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACT
GGGGTCGGGGAACCCTGGTCACCGTCTCGAGC (SEQ ID NO: 810)

BMS3h-37-5
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCAGGCTCCAGGGAAGGGTCTAGAGTGGATCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACA
GGGGTTCAGGGAACCCTGGTCACCGTCTCGAGC (SEQ ID NO: 811)

BMS3h-37-6
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGTCTAGAGTGGGTCTCAGCGATTTCTGG
TGATGGTTATCGTACATACTACGCAGACTCCGTGAAAGGCCGGTTCACCATCTCCCGCGACAATTCCGAGAACACGCTG
TATCTGCAAATGAACAGCCTGCGTGCCGAGGACACCGCGGTATATTACTGTGCGAAAGAGCTTGGGTATTTTGACTACT
GGGGTCGGGGAACCCTGGTCACCGTCTCGAGC (SEQ ID NO: 812)

BMS3h-37-7
GAGGTGCAGCTGTTGGAGACTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGTCTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGGACAGCCTGCGTGCCGAGGACACCGCGGTATATTACTGTGCGAAAGAGCTTGGGTATTTTGACTACT
GGGGTCGGGGAACCCTGGTCACCGTCACGAGC (SEQ ID NO: 813)

BMS3h-37-8
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCAGGCTCCAGGGAAGGGTCTAGAGTGGGTCTCAGCGATTTCTGG
TGATGGTTATCGTACATACTACGCAGACTCCGTGAAAGGCCGGTTCACCATCTCACGCGACAATTCCAAGAACACGCTG
TATCTGCAAATGAACAGCCTGCGTGCCGAGGACACCGCGGTATATTACTGTGCGAAAGAGCTTGGGTATTTTCACTACT
GGGGTCGGGGAACCCTGGTCACCGTCTCGAGC (SEQ ID NO: 814)

BMS3h-37-9
GAGGTGCAGCTGTTGGAGTCTGGGGGAGGCTTGGTACAGCCTGGGGGGTCCCTGCGTCTCTCCTGTGTAGCCTCCGGAT
TCACCTTTGAGTGGTATGAGATGCAGTGGGTCCGCCAGGCTCCAGGGAATGGTCTAGAGTGGATCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACT
GGGGTCGGGGAACCCTGGTCACCGTCTCGAGC (SEQ ID NO: 815)

BMS3h-37-10
GAGGTGCAGCTGTTGGAGTCTGGGGGAGGCTTGGTACAGCCTGGGGGGTCCCTGCGTCTCTCCTGTGCAGCCTCTGGAT
TCACCTTTGAGTGGTATGAGATGCAGTGGGTCCGCCGGGCTCCAGGGAAGGGTCTAGAGTGGGTCTCAGCGATATCTGG
TGATGGTTATCGTACATACTACGCAGACTCCGTGAAAGGCCGGTTCACCATCTCCCGCGACAATTCCAAGAACACGCTG
TATCTGCTAATGAACAGCCTGCGTGCCGAGGACACCGCGGTATATTACTGTGCGAAAGAGCTTGGGTATTTCGACTACT
GGGGTCGGGGAACCCTCGTCACCGTCTCGAGC (SEQ ID NO: 816)

BMS3h-37-11
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCAAGGCTCCAGGGAAGGGTCTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACA
GGGGTCGGGGAACCCTGGTCACCGTCTCGAGC (SEQ ID NO: 817)

TABLE 4-continued

Human Anti-CD40 Variable Domain Encoding Nucleotide Sequences

BMS3h-37-12
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGTCTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACA
GGGGTCGGGGAACCCTGGTCACCGTCTCGAGC (SEQ ID NO: 818)

BMS3h-37-201
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGATTAGAGTGGGTCTCAATGATTTCCGG
GGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACT
GGGGTCGGGGAACCCTGGTCACCGTCTCGAGC (SEQ ID NO: 819)

BMS3h-37-202
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGACGGTTGGCGCACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTTGGGTATTTTGACTACT
GGGGTCGGGGAACCCTGGTCACCGTCTCGAGC (SEQ ID NO: 820)

BMS3h-37-203
GAGGTGCAGCTGTTGGAGTCTGGGGGAGGCTTGGTACAGCCTGGGGGGTCCCTGCGTCTCTCCTGTGCAGCCTCCGGAT
TCACCTTTGGGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTGCTCTACTTTGACTACT
GGGGTCGGGGAACCCTGGTCACCGTCTCGAGC (SEQ ID NO: 821)

BMS3h-37-204
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTGGGGTTCTTTGACTACT
GGGGTCGGGGAACCCTGGTCACCGTCTCGAGC (SEQ ID NO: 822)

BMS3h-37-205
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGTTGGAGTATTTTGACTACT
GGGGTCGGGGAACCCTGGTCACCGTCTCGAGC (SEQ ID NO: 823)

BMS3h-37-206
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGATACCGCGGTATATTACTGTGCGAAAGGTTGGAGTATTTTGACTACT
GGGGTCGGGGAACCCTGGTCACCGTCTCGAGC (SEQ ID NO: 824)

BMS3h-37-207
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTGGCCTTCTTTGACTACT
GGGGTCGGGGAACCCTGGTCACCGTCTCGAGC (SEQ ID NO: 825)

BMS3h-37-208
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTCTTGTACTTTGACTACT
GGGGTCGGGGAACCCTGGTCACCGTCTCGAGC (SEQ ID NO: 826)

BMS3h-37-209
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGTTGGAGTTCTTTGACTACT
GGGGTCGGGGAACCCTGGTCACCGTCTCGAGC (SEQ ID NO: 827)

BMS3h-37-210
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCTGCAGTTCTTTGACTACT
GGGGTCGGGGAACCCTGGTCACCGTCTCGAGC (SEQ ID NO: 828)

TABLE 4-continued

Human Anti-CD40 Variable Domain Encoding Nucleotide Sequences

BMS3h-37-211
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCTGCTCTTCTTTGACTACT
GGGGTCGGGGAACCCTGGTCACCGTCTCGAGC (SEQ ID NO: 829)

BMS3h-37-212
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGATACCGCGGTATATTACTGTGCGAAAGAGTTGGAGTTCTTTGACTACT
GGGGTCGGGGAACCCTGGTCACCGTCTCGAGC (SEQ ID NO: 830)

BMS3h-37-213
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGTTGCTCTTCTTTGACTACC
GGGGTCGGGGAACCCTGGTCACCGTCTCGAGC (SEQ ID NO: 831)

BMS3h-37-214
GAGGTGCAGCTGTTGGAGTCTGGGGGAGGCTTGGTACAGCCTGGGGGGTCCCTGCGTCTCTCCTGTGCAGCCTCCGGAT
TCATCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGATACCGCGGTATATTACTGTGCGAAAAACTTGGAGTATTTTGACTACT
GGGGTCGGGGAACCCTGGTCACCGTCTCGAGC (SEQ ID NO: 832)

BMS3h-37-215
GAGGTGCGGCTGTTGGAGTCTGGGGGAGGCTTGGTACAGCCTGGGGGGTCCCTGCGTCTCTCCTGTGCAGCCTCCGGAT
TCACCTTTGAGTGGTATGAGATGCAGTGGGTCCGCCGGGCTCCAGGGAAGGGACTAGAGTGGGTCTCAGCGATTTCTGG
TGATGGTTATCGTACATACTACGCAGACTCCGTGAAAGGCCGGTTCACCATCTCCCGCGACAATTCCAAGAACACGCTG
TATCTGCAAATGAACAGCCTGCGTGCCGAGGACACCGCGGTATATTACTGTGCGAAAGAGTTGCAGTTCTTTGACTACT
GGGGTCGGGGAACCCTGGTCACCGTCTCGAGC (SEQ ID NO: 833)

BMS3h-38-1
GAGGTGCAGCTGTTGGGGTCTGGGGGAGGCTTGGTACAGCCTGGGGGGTCCCTGCGTCTCTCCTGTGCAGCCTCCGGAT
TCACCTTTGAGGAGGAGGAGATGATTTGGGTCCGCCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTTCGAAAGAGCCGTTTCGTTTTGACTACT
GGGGTCAGGGAACCCTGGTCACCGTCTCGAGC (SEQ ID NO: 834)

BMS3h-38-2
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 835)

BMS3h-38-3
GAGGTGCAGCTGTTGGCGTCTGGGGGAGGCTTGGTACAGCCTGGGGGGTCCCTGCGTCTCTCCTGTGCAGCCTCCGGAT
TCACCTTTGAGGAGGAGGAGATGATTTGGGTCCGCCAGGCTCCAGGGAAGGGTCTAGAGTGGATCTCAGCTATTAGTGG
AAGTGGTGGTAGCACATACTACGCAGACTCCGTGAAGGGCCGGTTTACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTTTGACTACT
GGGGTCAGGGAACCCTGGTCACCGTCTCGAGC (SEQ ID NO: 836)

BMS3h-38-4
GAGGTGCAGCTGTTGGATCCTGGGGGAGGCTTGGTACAGCCTGGGGGGTCCCTGCGTCTCTCCTGTGCAGCCTCCGGAT
TCACCTTTGGGAAGGAGGAGATGATTTGGGTCCGCCAGGCTCCAGGGAAGGGTCTAGAGTGGGTCTCATCTATTAGTGG
TAGTGGTGGTAGCACATACTACGCAGACTCCGTGAAGGGCCGGTTCACCATCTCCCGCGACAATTCCAGGAACACGCTG
TATCTGCAAATGAACAGCCTGCGTGCCGAGGATACCGCGGTATATTACTGTGGGAAAGAGCCGTTTCGTTTTGACTACT
GGGGTCAGGGAACCCTGGTCACCGTCTCGAGC (SEQ ID NO: 837)

BMS3h-38-5
GAGGTGCAGCTGTTGGGGTCTGGGGGAGGCTTGGTACAGCCTGGGGGGTCCCTGCGTCTCTCCTGTGCAGCCTCCGGAT
TCACCTTTGAGGAGGAGGAGATGATTTGGGTCCGCCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTTTGACTACT
GGGGTCAGGGAACCCTGGTCACCGTCTCGAGC (SEQ ID NO: 838)

BMS3h-38-6
GAGGTGCAGCTGTTGGGAGCCTGGGGGAGGCTTGGTACAGCCTGGGGGCTCCCTGCGTCTCTCCTGTGCAGCCTCCGGAT
TCACCTTTGAGGAGGAGGAGATGATTTGGGTCCGCCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCTAATGAACAGCCTGCGTGCCGAGGATACCGCGGTATATTACTGTTCGAAAGAGCCGTTTCGTTTTGACTACT
GGGGTCAGGGAGCCCTGGTCACCGTCTCGAGC (SEQ ID NO: 839)

TABLE 4-continued

Human Anti-CD40 Variable Domain Encoding Nucleotide Sequences

BMS3h-38-7
GAGGTGCAGCTGTTGGATCCTGGGGGAGGCTTGGTACAGCCTGGGGGGTCCCTGCGTCTCTCCTGTGCAGCCTCCGGAT
TCACCTTTGGGAAGGAGGAGATGATTTGGGTCCGCCAGGCTCCAGGGAAGGGTCTAGAGTGGGTCTCATCTATTAGTGG
TAGTGGTGGTAGCACATACTACGCAGACTCCGTTAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGTTACGTTTTGACTACT
GGGGTCAGGGAACCCTGGTCACCGTCTCGAGC (SEQ ID NO: 840)

BMS3h-38-8
GAGGTGCAGCTGTTGGAGTCTGGGGGAGGCTTGGTACAGCCTGGGGGGTCCCTGCGTCTCTCCTGTGCAGCCTCCGGAT
TCACCTTTGAGGAGGAGGAGATGATCTGGGTCCGCCAGGCTCCTGGGAAGGGTCTAGAGTGGATCTCAGCTATTAGTGG
TAGTGGTGGTAGCACATACTACGCAGACTCCGTGAAGGGCCGGTTCACCATCCACCGCGACAATTCTAAGAACACTCTG
TATCTGCAAATGAACAGCCTGCGTGCCGAGGATACCGCGGTATATTACTGTTCGAAAGAGCCGTTTCGTTTTGACTACA
GGGGTCTGGGAACCTTGGTCACCGTCTCGAGC (SEQ ID NO: 841)

BMS3h-38-9
GAGGTGCAGCTGTTGGATCCTGGGGGAGGCTTGGTACAGCCTGGGGGGTCCCTGCGTCTCTCCTGTGCAGCCTCCGGAT
TCACCTTTGGGAAGGAGGAGATGATTTGGGTCCGCCAGGCTCCAGGGAAGGGTCTAGAGTGGGTCTCATCTATTAGTGG
TAGTGGTGGTAGCACATACTACGCAGACTCCGTGAAGGGCCGGTTCACCATCTCCCGCGACAATTCCAGGAACACGCTG
TATCTGCAAATGAACAGCCTGCGTGCCGAGGATACCGCGGTATATTACTGTGCGAAAGAGCCGTTACGTTTTGACTACT
GGGGTCAGGGGACCCTGGTCACCGTCTCGAGC (SEQ ID NO: 842)

BMS3h-38-10
GAGGTGCAGCTGTTGGATTCTGGGGGAGGCTTTGTACAGCCTGGGGGGTCCCTGCGTCTCTCCTGTGCAGCCTCCGGAT
TCACCTTTGAGGAGGAGGAGATGATTTGGGTCCGCCAGGCTCCAGGGAAGGGTCTAGAGTGGATCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTGTATTACTGTGCGAAAGAGCCGTTTCGTTTTGACTACT
GGGGTCAGGGAACCCTGGTCACCGTCTCGAGC (SEQ ID NO: 843)

BMS3h-38-11
GAGGTGCAGCTGTTGGATCCTGGGGGAGGCTTGGTACAGCCTGGGGGGTCCCTGCGTCTCTCCTGTGCAGCCTCCGGAT
TCACCTTTGAGGAGGAGGAGATGATTTGGGTCCGCCAGGCTCCAGGGAAGGGTCTAGAGTGGATCTCAGCTATTAGTGG
TAGTGGTGGTAGCACATACTACGCAGACTCCGTGAAGGGCCGGTTCACCATCTCCCGCGACAATTCAATAACACGCTG
TATCTGCAAATGAACAGCCTGCGTGCCGAGGATACCGCGGTATATTACTGTGGGAGAGAGCCGTTTCGTTTTGACTACT
GGGGTCAGGGAACCCTGGTCACCGTCTCGAGC (SEQ ID NO: 844)

BMS3h-38-12
GAGGTGCGGCTGTTGGAGTCTGGGGAAGGCTTGGTACAGCCTGGGGGGTCCCTGCGTCTCTCCTGTGCAGCCTCCGGAT
TCACCTTTGAGGAGGAGAGATGATTTGGGTCCGCCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCACGCGACAATTCCAAGAACACGCTG
TATCTGCAAATGAACAGCCTGCGTGCCGAGGATACCGCGGTATATTACTGTGGGAAAGAGCCGTTTCGTTTTGACTACT
GGGGTCAGGGAACCCTGGTCACCGTCTCGAGC (SEQ ID NO: 845)

BMS3h-38-13
GAGGTGCAGCAGTTGGAGTCTGGGGGAGGCCTGGTACAGCCTGGGGGGTCCCTGCGTCTCTCCTGTGCAGCCTCCGGAT
TCACCTTTGAGGAGGAGGAGATGATTTGGGTCCGCCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTTTGACTACT
GGGGTCAGGGAACCCTGGTCACCGTCTCGAGC (SEQ ID NO: 846)

BMS3h-38-201
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTCTACTACGACTACT
GGGGTCAGGGAACCCTGGTCACCGTCTCGAGC (SEQ ID NO: 847)

BMS3h-38-202
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTCTACTTCGACTACT
GGGGTCAGGGAACCCTGGTCACCGTCTCGAGC (SEQ ID NO: 848)

BMS3h-38-203
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGAAGGAGATGATTTGGGTCCGTCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTCTTCTACGACTACT
GGGGTCAGGGAACCCTGGTCACCGTCTCGAGC (SEQ ID NO: 849)

BMS3h-38-204
GAGGTGCAGCTGTTGGCGTCTGGGGGAGGCTTGGTACAGCCTGGGGGGTCCCTGCGTCTCTCCTGCGCAGCCTCCGGAT
TCACCTTTCCCCAGGAGGAGATGATTTGGGTCCGTCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 850)

TABLE 4-continued

Human Anti-CD40 Variable Domain Encoding Nucleotide Sequences

BMS3h-38-205
GAGGTGCAGCTGTTGGCGTCTGGGGGAGGCTTGGTACAGCCTGGGGGGTCCCTGCGTCTCTCCTGCGCAGCCTCCGGAT
TCACCTTTTTCGCCGCCGAGATGATTTGGGTCCGCCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 851)

BMS3h-38-206
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTAG
GCCCGGTACGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 852)

BMS3h-38-207
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
GATGGGTTTCAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 853)

BMS3h-38-208
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
GTGGGGTCACAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 854)

BMS3h-38-209
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
CCTCGGTTGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 855)

BMS3h-38-210
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTCG
CTGGGGTGCCAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 856)

BMS3h-38-211
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTAG
GCAGGGTGGGAGCACATACTACGCAGACTCCGTGAAGGGCCGGTTCACCATCTCCCGTGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 857)

BMS3h-38-212
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTGT
GTCCGGTTGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 858)

BMS3h-38-213
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
GTGGGGTTGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 859)

BMS3h-38-214
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
GAACGGTCTGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 860)

BMS3h-38-215
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTGG
GCTGGGTTGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 861)

TABLE 4-continued

Human Anti-CD40 Variable Domain Encoding Nucleotide Sequences

BMS3h-38-216
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTGC
GTTGGGTTGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 862)

BMS3h-38-217
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
CAGGGGTTACAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 863)

BMS3h-38-218
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTAG
GCACGGTTGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 864)

BMS3h-38-219
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAAGCATTAGCAG
GAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 865)

BMS3h-38-220
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
GATCGGTAACAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 866)

BMS3h-38-221
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTGG
GCACGGTTGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 867)

BMS3h-38-222
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTTCGAG
GTGGGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 868)

BMS3h-38-223
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTCATGTATGACTACT
GGGGTCAGGGAACCCTGGTCACCGTCTCGAGC (SEQ ID NO: 869)

BMS3h-38-224
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTCCCGTACGACTACT
GGGGTCAGGGAACCCTGGTCACCGTCTCGAGC (SEQ ID NO: 870)

BMS3h-38-225
GAGGTGCAGCTGTTGGCGTCTGGGGGAGGCTTGGTGCAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTGG
TAGTGGTGGTGGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 871)

BMS3h-38-226
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTGTACTATGACTACT
GGGGTCAGGGAACCCTGGTCACCGTCTCGAGC (SEQ ID NO: 872)

TABLE 4-continued

Human Anti-CD40 Variable Domain Encoding Nucleotide Sequences

BMS3h-38-227
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGTCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCCATGTACTATGACTACT
GGGGTCAGGGAACCCTGGTCACCGTCTCGAGC (SEQ ID NO: 873)

BMS3h-38-228
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTAG
GAACGGTTTCAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 874)

BMS3h-38-229
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
CACGGGTGGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 875)

BMS3h-38-230
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
GGAGGGTGGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 876)

BMS3h-38-231
GAGGTGCAGCTGTTGGCGTCTGGGGGAGGCTTGGTACAGCCTGGGGGGTCCCTGCGTCTCTCCTGCGCAGCCTCCGGGT
TCCCCTTTGAGGAGGAGGAGATGATTTGGGTCCGCCAGGCTCCAGGGAAGGGTCTAGAGTGGGTCTCAGCTATTAGTCG
GCAGGGTTGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 877)

BMS3h-38-232
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTAG
GGGCGGTGGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 878)

BMS3h-38-233
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
CACGGGTTACAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 879)

BMS3h-38-234
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTAG
GAACGGTAGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 880)

BMS3h-38-235
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTAG
GAACGGTTACAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 881)

BMS3h-38-236
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTAG
GAAGGGTAGCAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 882)

BMS3h-38-237
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
GGGCGGTTGGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 883)

TABLE 4-continued

Human Anti-CD40 Variable Domain Encoding Nucleotide Sequences

BMS3h-38-238
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTCG
CTCGGGTTACAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 884)

BMS3h-38-239
GAGGTGCAGCTGTTGGCGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTAG
GAACGGTATGAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 885)

BMS3h-38-240
GAGGTGCAGCTGTTGGAGTCTGGGGGAGGCTTGGTACAGCCTGGGGGGTCCCTGCGTCTCTCCTGCGCAGCCTCCGGAT
TCACCTTTGAGGAGGAGGAGATGATTTGGGTCCGCCAGGCTCCAGGGAAGGGTCTAGAGTGGGTCTCAGCTATTAGTAG
GAACGGTTACAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 886)

BMS3h-41-1
GAGGTGCAGCTGTTGGAGTCTGGGGGAAGGCTTGGTACAGCCTGGGGGGTCCCTGCGTCTCTCCTGTGCAGCCTCCGGAT
TCACCTTTACTGAGCATGAGATGATTTGGGTCCGCCAGGCTCCAGGGAAGGGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTCCCGAGGACACCGCGGTATATTACTGTGCGAAAGAGCCGCTTAGGTTTGACTACT
GGGGCCAGGGAACCCTGGTCACCGTCTCGAGC (SEQ ID NO: 887)

BMS3h-41-2
GAGGTGCAGCTGTTGGAGTCTGGGGGAGGCTTGGTACAGCCTGGGGGGTCCCTGCGTCTCTCCTGTGCAGCCTCCGGAT
CCACCTTTACTGAGTATGAGATGATTTGGGTCCGCCAGGCTCCAGGGAAGGGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTTCTGTGCGAAAGAGCCGCTTAGGTTTGACTACA
GGGGTCAGGGAACCCTGGTCACCGTCTCGAGC (SEQ ID NO: 888)

BMS3h-41-3
GAGGTGCAGCTGTTGGAGCCTGGGGGAGGCTTGGTACAGCCTGGGGGGTCCCTGCGTCTCTCCTGTGCAGCCTCCGGAT
TCACCTTTACTGAGTATGAGATGATTTGGGTCCGCAAGGCTCCAGGGAAGGGTATGGAGTGGGTCTCATCTATTTCGGG
TAATGGTGCTAATACATACTACGCAGACTCCGTGAAGGGCCGGTTCACCATCTCCCGCGACAATTCCAAGAACATGCTG
TATCTGCAAATGAACAGCCTGCGTGCCGAGGACACCGCGGTATATTACTGTGCGAAAGAGCCGCTTAGGTTTGGCTACT
GGGGTCAGGGTACCCTGGTCACCGTCTCGAGC (SEQ ID NO: 889)

BMS3h-41-4
GAGGTGCAGCTGTTGGATTCTGGGGGAGGCTTGGTACAGCCTGGGGGGTCACTGCGTCTCTCCTGTGCAGCCTCCGGAT
TCACCTTTACTGAGTATGAGATGATTTGGGTCCGCCAGGCTCCAGGGAAGGGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTACAAATGAACAGCCTGCGTGCCGAGGACACCGCGGTATATTACTGTGCGAAAGAGCCGCTTAGGTTTGACTACT
GGGGTCGGGGAACCCTGGTCACCGTCTCGAGC (SEQ ID NO: 890)

BMS3h-41-5
GAGGTGCAGCTGTTGGGGTCAGGGGGAGGCTTGGTACAGCCTGGGGGGTCCCTGCGTCTCTCCTGTGCAGCCTCCGGAT
TCACCTTTACTGAGTATGAGATGATTTGGGTCCGCCAGGCTCCAGGGAAGAGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGCTTAGGTATGACGACT
GGGGTCAGGGAACCCTGGTCACCGTCTCGAGC (SEQ ID NO: 891)

BMS3h-41-6
GAGGTGCAGCCGTTGGAGTCTGGGGGAGGCTTGGTACAGCCTGGGGGGTCCCTGCGTCTCTCCTGTTCAGCCTCCGGAT
TCACCTTTAATGAGTATGAGATGATTTGGGTCCGCCAGGCTCCAGGGAAGGGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGCTTAGGTTTGACTACT
GGGGTCAGGGAACCCTGGTCACCGTCTCGAGC (SEQ ID NO: 892)

BMS3h-41-7
GAGGTGCAGCTGTTGGAGTCTGGGGAAGGCTTGGTACAGCCTGGGGGGTCCCTGCGTCTCTCCTGTGCAGCCTCCGGAT
TCACCTTTGCTGAGTATGAGATGATTTGGGTCCGCCAGGCTCCAGGGAAAGGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGCTTAGGTTTGACTACT
GGGGTCAGGGAACCCTGGTCACCGTCTCGAGC (SEQ ID NO: 893)

BMS3h-41-8
GAGGTGCAGCTGTTGGACCCTGGGGGAGGCTTGGTACAGCCTGGGGGGTCCCTGCGTCTCTCCTGTGCAGCCTCCGGAT
TCACCTTTACTGAGTCTGAGATGATTTGGGTCCGCCAGGCTCCAGGGAAGGGTCTGGAGTGGGTCTCATCTATTTCGGG
AAATGGTGCTAATACATACTACGCGGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGCTTAGGTTTGACTACT
GGGGTCAGGGAACCCTGGTCACCGTCTCGAGC (SEQ ID NO: 894)

TABLE 4-continued

Human Anti-CD40 Variable Domain Encoding Nucleotide Sequences

BMS3h-41-9
GAGGTGCAGCTGTTGGAGCCTGGGGGAGGCTTGGTACAGCCTGGGGGGTCCCTGCGTCTCTCCTGTGCAGCCTCCGGAT
TCACCTTTACTGAGTATGAGATGATTTGGGTCCGCAAGGCTCCAGGGAAGGGTATGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTCCCGAGGACACCGCGGTATATTACTGTGCGAAAGAGCCGCTTAGGTTTGACGACT
GGGGTCAGGGAACCCTGGTCACCGTCTCGAGC (SEQ ID NO: 895)

BMS3h-41-10
GAGGTGCAGCTGTTGGAGTCTGGGGTAGGCTTGGTACAGCCTGGGGGGTCCCTGCGTCTCTCCTGTGCAGCCTCCGGAT
TCACCTTTACTGAGTATGAGATGATTTGGGTCCGCAAGGCCCCAGGGAAGGGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAACCGCTTAGGTTTGACAACT
GGGGTCAGGGAACCCTGGTCACCGTCTCGAGC (SEQ ID NO: 896)

BMS3h-41-11
GAGGTGCAGTTGTTGGAGTCTCGGGGAGGCTTGGTACAGCCTGGGGGGTCCCTGCGTCTCTCCTGTGCAGCCTCCGGAT
TCACCTTTACTGAGCATGAGATGATTTGGGTCCGCCAGGCTCCAGGGAAGGGTCTGGAGTGGGTCTCATCTATTTCGGG
TAATGGTGCTAATACATACTACGCAGACTCCGTGAAGGGCCGGTTCCGTCTCCCGCGACAATTCCAAGAACACGCTG
TATCTGCAAATGAACAGCCTGCGTGCCGAGGACACCGCGGTATATTACTGTGCGAAAGAGCCGCTTAGGTTTGACTACT
GGGGTCAGGGAACCCTGGTCACCGTCTCGAGC (SEQ ID NO: 897)

BMS3h-41-12
GAGGTGCAGCCGTTGGAGTCTGGGGGAGGCTTGGTACAGCCTGGGGGGTCCCTGCGTCTCTCCTGTGCTGCCTCCGGAT
TCACCTTTACTGAGTATGAGATGATTTGGGTCCGCCAGGCTCCAGGGAAGGGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGCTTAGGTTTGACTACT
GGGGTCAGGGAACCCTGGTCACCGTCTCGAGC (SEQ ID NO: 898)

BMS3h-41-13
GAGGTGCAGCTGTTGGAGTCTGCGGGAGGCTTGGTACAGCCTGGGGGGTCCCTGCGTCTCTCCTGTGCAGCCTCCGGAT
TCACCTTTGCTGAGTATGAGATGATTTGGGTCCGCCAGGCTCCAGGGAAGGGTCTGGAGTGGGTCTCATCAATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGCTTAGGTTTGACTACT
GGGGTCAGGGAGCCCTGGTCACCGTCTCGAGC (SEQ ID NO: 899)

BMS3h-41-14
GAGGtGCAGCtGTTGGAGCCTGGGGGAGGCTTGGTACAGCCTGGGGGGTCGCTGCGTCTCTCCTGTGCAGCCTCCGGAT
TCACCTTTACTGAGTATGAGATGATTTGGGTCCGCCAGGCTCCAGGGAAGGGTCTGGAGTGGGTCTCATCTATTTCGGG
TAATGGTGCTAATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGCTTAGGTTTGACAACT
GGGGTCAGGGAACCCTGGTCACCGTCTCGAGC (SEQ ID NO: 900)

BMS3h-43-1
GAGGTGCAGCTGTTGGAGTCTGGGGGAGGCTTGGTACAGCCTGGGGGGTCTCTGCGTCTCTCCTGTACAGCCTCCGGAT
TCACCTTTAATATGTATGAGATGTCGTGGGTCCGCCAGGCTCCAGGGAAGGGTCTAGAGTGGGTCTCAGGTATTAGTAG
ACGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGATTTGA
GGTATGCGCGTTTTGACTACTCGGGTCAGGGAACCCTGGTCACCGTCTCGAGC (SEQ ID NO: 901)

BMS3h-43-2
GAGGAGCAGCTGTTGGAGTCTGGGGGAGGCTTGGTACAGCCTGGGGGGTCCCTGCGTCTCTCCTGTACAGCCTCCGGAT
TCACCTTTAATATGTATGAGATGTCGTGGGTCCGCCAGGCTCCAGGGAAGGGTCTAGAGTGGGTCTCAGGTATTAGTAG
ACGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGCTACGA
GGTATGCGCGTTTTGACTACTGGGGTCAGGGAACCCTGGTCACCGTCTCGAGC (SEQ ID NO: 902)

BMS3h-43-3
GAGGTGCAGCTGTTGGAGTCTGGGGGAGGCTTGGTACAGCCTGGGGGGTCCCTGCGTCTCTCCTGTACAGCCTCCGGAT
TCACCTTTAATATGTATGAGATGTCGTGGGTCCGCCAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGCGACAATTTCAAGAACACGCTG
TATCTGCAAATGAACAGCCTGCGTGCCGAGGATACCGCGGTATATTACTGTGCGAAAGAGCCGATTACGTATGATATGA
GGTATGCGCGTTTTGACTACGGGGGTCAGGGAACCCTGGTCACCGTCTCGAGC (SEQ ID NO: 903)

BMS3h-43-4
GAGGTGCAGCTGTTGGAGTCTGGGGGAGGCTTGGTACAGCCTGGGGGGTCCCTGCGTCTCTCCTGTACAGCCTCCGGAT
TCACCTTTAATATGTATGAGATGTCGTGGGTCCGCCAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGATATGA
GGTATGCGCGTTTTGACAACTGGGGTCAGGGAACCCTGGTCACCGTCTCGAAC (SEQ ID NO: 904)

BMS3h-43-5
GAGGTGCAGCTGTTGGAGTCTGGGGGAGGCTTGGTACAGCCTGGGGGGTCCCTGCGTCTCTCCTGTACAGCCTCCGGAT
TCACCTTTAATACGTATGAGATGTCGTGGGTCCGCCAGGCTCCAGGGAAGGGTCTAGAGTGGGTCTCAGGTATTGGTAG
GCGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGATTTGA
GGTATGCGCGTTTTGACTACTCGGGTCAGGGAACCCTGGTCACCGTCTCGAGC (SEQ ID NO: 905)

TABLE 4-continued

Human Anti-CD40 Variable Domain Encoding Nucleotide Sequences

BMS3h-43-6
GAGGTGCAGCTGATGGAGTCAGGGGGAGGCTTGGTACAGCCTGGGGGGTCCCTGCGTCTCTCCTGTACAGCCTCCGGAT
TCTCCTTTAATATGTATGAGATGTCGTGGGTCCGCCAGGCTCCAGGGAAAGGTCTAGAGTGGGTCTCAGGTATTAGTAG
GCGTGGTTATACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGATATGA
GGTATGCGCGTTTTGACTACTGGGGTCGGGGAACCCTGGTCACCGTCTCGAGC (SEQ ID NO: 906)

BMS3h-43-7
GAGGTGCAGCTGTTGGAGTCTGGGGGAGGCTTGGTGCAGCCTGGGGGGTCCCTGCGTCTCTCCTGTACAGCCTCCGGAT
TCGCCTTTAATATGTATGAGATGTCGTGGGTCCGCCAGGCTCCAGGGAAGGGACTAGAGTGGGTCTCAGGTATTAGTAG
GCATGGTTTTACTACGTACTACGCAGACTCCGTGAAGGGCCGGTTCACCGTCTCCCGCGACAATTCCAAGAACACGCTG
TATCTGCAAATGAACAGCCTGCGTGCCGAGGATACCGCGGTATATTACTGTGCGAAAGAGCCGATTACGTATGATATGC
GGTATGCGCGTTCTGACTACTGGGGTCAGGGAACCCTGGTCACCGTCTCGAGC (SEQ ID NO: 907)

BMS3h-43-8
GAGGTGCAGCTGTTGGAGTCTGGGGGAGGCTTGGTACAGCCTGGGGGGTCCCTGCGTCTCTCCTGTACAGCCTCCGGAT
TCACCTTTAATATGTATGAGATGTCGTGGGTCCGCCAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTCTGTGCGAAAGAGCCGATTACGTATGATATGA
GGTATGCGCGTTCTGACTACTGGGGTCAGGGAACCCTGGTCACCGTCTCGAGC (SEQ ID NO: 908)

BMS3h-43-9
GAGGTGCAGCTGTTGGAGTCTGGGGGGGGCTTGGTTCAGCCTGGGGGGTCCCTGCGTCTCTCCTGTACAGCCTCCGGGT
TCACCTTTAATATGTATGAGATGTCGTGGGTCCGCCAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATTCTATGA
GGTATGCGCGTTTTGACTACTCGGGTCTGGGAACCATGGTCACCGTCTCGAGC (SEQ ID NO: 909)

BMS3h-43-10
GAGGTGCAGCTGCTGGAGTCTGGGGGAGGCTTGGTACAGCCTGGGGGGTCCCTTCGTCTCTCCTGTACAGCCTCCGGAT
TCACCTTTAATATGTATGAGATGTCGTGGGTCCGCCAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGATATGA
GGTATGCGCGTTTTGACTACAGTGGTCAGGGAACCCTGGTCACCGTCTCGAGC (SEQ ID NO: 910)

BMS3h-43-11
GAGGTGCAGCTGTTGGAGTCTGGAGGAGGCTTGGTACAGCCTGGGGGGTCCCTGCGTCTCTCCTGTACAGCCTCCGGAT
TCACCTTTAATATGTATGAGATGTCGTGGGTCCGCAAGGCTCCAGGGAAGGGTCTAGAGTGGGTCTCAGGTATTAGTAG
GCATGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGATATGA
GGTATGCGCGTTTTGACTACTGGGGTCAGGGAACCCTGGTCACCGTCTCGAGC (SEQ ID NO: 911)

BMS3h-43-12
GAGGTGCAGCTGTTCGAGTCTGGGGGAGGCTTGGTACAGCCTGGGGGGTCCCTGCGTCTCTCCTGTACAGCCTCCGGAT
TCACCTTTAATATGTATGAGATGTCGTGGGTCCGCCAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAGGAGCCGATTACGTATGATATGA
GGTATGCGCGTTTTGACTACTGGGGTCGGGGAACCCTGGTCACCGTCTCGAGC (SEQ ID NO: 912)

BMS3h-43-13
GAGGTGCAGCTGTTGGAGTCTGGGGGAGGCTTGGTACAGCCTGGGGGATCCCTGCGTCTCTCCTGTACAGCCTCCGGTT
TCACCTTTAATATGTATGAGATGTCGTGGGTCCGCCAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGATATGA
GGTATGCGCGTTTTGACTACTGGGGTCGGGAACCCTGGTCACCGTCTCGAGC (SEQ ID NO: 913)

BMS3h-43-14
GAGGTGCAGCTGTTGGAGTCTGGGGGAGGCTCGGTACAGCCTGGGGGGTCCCTGCGTCTCTCCTGTACAGCCTCCGGAT
TCTCCTTTAATATGTATGAGATGTCGTGGGTCCGCCAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGAGCCGATTACGTATGATATGA
GGTATGCGCGTTTTGACTACTGGGGTCAGGGAACCCTGGTCACCGTCTCGGGC (SEQ ID NO: 914)

BMS3h-43-15
GAGGTGCAGCTGTTGGAGTCTGGGGGAGGCTTGGTACAACCTGGGGGGTCCCTGCGTCTCTCCTGTACAGCCTCCGGAT
TCACCTTTAATATGTATGAGATGTCGTGGGTCCGCAAGGCTCCAGGGAAGGGTCTAGAGTGGGTCTCAGGTATTAGTAG
GCGTGGTTTTACTACATACTACGCAGACTCCGTGAAGGGCCGGTTCACCATCTCCCGTGACAATTCCAAGAACACGCTG
TATCTGCAAATGAACAGCCTGCGTGCCGAGGATACCGCGGTATATTACTGTGCGAAAGAGCCGATTACGTATGATATGA
GGTATGCGCGTTTTGACTACTGGGGTCAGGGAACCCTGGTCACCGTCTCGAGC (SEQ ID NO: 915)

BMS3h-56-1
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAACTTCCGTTTACTTTTGAGGACT
GGGGTCAGGGAACCCTGGTCACCGTCTCGAGC (SEQ ID NO: 916)

TABLE 4-continued

Human Anti-CD40 Variable Domain Encoding Nucleotide Sequences

BMS3h-56-2
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 917)

BMS3h-56-3
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCAGAGGATACCGCGGTATATTACTGTACGAAACTTCCGTTTATTTTGAATACT
GGGGTCAGGGAACCCTGGTCACCGTCTCGAGC (SEQ ID NO: 918)

BMS3h-56-4
GAGGTGCAGCTGTTGGAGTCCGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTATGTTTGACGACC
GGGGTCAGGGAACCCTGGTCACCGTCTCGAGC (SEQ ID NO: 919)

BMS3h-56-5
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 920)

BMS3h-56-6
GAGGTGCAGCTGTTGGAGTCTGGGGGAGGCTTGGTACAGCCTGGGGGGTCCCTGCGTCTCTCCTGTGCAGCCTCCGGAT
TCTCCTTTCGGGATTATGAGATGTGGTGGTACCGCCAGGCTCCAGGGAAGGGTCTAGAGCGGGTCTCAGCTATTAATCC
GCAGGGTACGCGTACATATTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTATTTTGACAACC
GGGGTCAGGGAACCCTGGTCACCGTCTCGAGC (SEQ ID NO: 921)

BMS3h-56-7
GAGGTGCAGCTGTTGGAGTCTGGGGGAGGCTTGGTACAGCCTGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCTCGGTATATCACTGTGCGAAACCTCCGTTTATTTTTGGCGACT
GGGGTCCGGGAACCCTGGTCACCGTCTCGAGC (SEQ ID NO: 922)

BMS3h-56-8
GAGGTGCAGCTGTTGGAGTCTGGGGGAGGCTTGGTACAGCCTGGGGGGTCCCGGCGTCTCTCCTGTGCAGCCTCCGGAT
TCACCTTTCGGGATTATGAGATGTGGTGGGTCCGCCAGGCTCCGGGGAAGGGTCTAGAGCGGGTCTCAGCTATTAATCC
GCAGGGTACGCGTACATACTACGCAGACTCCGTGAAGGGCCGGTTCACGATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 923)

BMS3h-56-9
GAGGTGCAGCTGTTGGAGTCTGGGGGAGGCTTGGTACAGCCTGGGGGGTCCCTGCGTCTATCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACTGCGGTATATTACTGTGCGAAACTTCCGTTTATGTTTGACGACC
GGGGTCAGGGAACCCTGGTCACCGTCTCGAGC (SEQ ID NO: 924)

BMS3h-56-10
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGTTCTAGAGCGGGTCTCAGCTATTAATCC
GCAGGGTACGCGTACATACTACGCAGACTCCGTGAAGGGCCGGTTCACCATCTCCCGCGACAATTCCAAGAACATGCTG
TATCTGCAAATGAACAGCCTGCGTGCCGAGGATACTGCGGTATATTACTGTGCGAAACTTCCGTTTATGTTTGACGACC
GGGGTCAGGGAACCCTGGTCACCGTCTCGAGC (SEQ ID NO: 925)

BMS3h-56-11
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGAGCCGAGGATACTGCGGTATATTACTGTGCGAAACTTCCGTTTATGTTTGACGACC
GGGGTCAGGGAACCCTGGTCACCGTCTCGAGC (SEQ ID NO: 926)

BMS3h-56-12
GAGGTGCAGCTGTTGGAGTCTGGGGGAGGCTTGATACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTTTGAAACTTCCGTTTATTTTCGACTACT
GGGGTCAGGGAACCCTGGTCACCGTCTCGAGC (SEQ ID NO: 927)

TABLE 4-continued

Human Anti-CD40 Variable Domain Encoding Nucleotide Sequences

BMS3h-56-13
GAGGTGCAGCTGTTGGAGTCTGGGGGAGGCTTGGTACAGCCTGGGGGGTCCCTGCGTCTATCCTGTGCAGCCTCCGGAT
TCACCTTTCGGGATTATGAGATGTGGTGGGTCCGCCAGGCTCCAGGGAAGGGTCTAGAGCGGGTCTCAGCTATTAACCC
GCAGGGTACGCGTACATACTATGCAGACTCCGTGAAGGGCCGGTTCACCATCTCCCGCGACAATTCCAAGAACACGCTG
TATCTGCAAATGAACAGCCTGCGTGCCGATGATACCGCGGTATATCACTGTACGAAACTTCCGTTTATTTTTGACTACT
GGGGTCAGGGAACCCTGGTCACCGTCTCGAGC (SEQ ID NO: 928)

BMS3h-56-14
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGATGGTTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTA
TATCTGCAAATGAACAGCCTGCGTGCCGAGGATACCGCGGTATATTACTGTGCGAAACTTCCGTTTTTTTTTGACTCCA
GGGGTCAGGGAACCCTGGTCACCGTCTCGAGC (SEQ ID NO: 929)

BMS3h-56-15
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCGGGCTCCAGGGAAGGGTCTAGAGCGGGTCTCAGCTATTAATCC
GCAGGGTACGCGTACATACTACGCAGACTCTGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 930)

BMS3h-56-16
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTACTTTTGAGGACT
GGGGTCAGGGAACCCTGGTCACCGTCTCGAGC (SEQ ID NO: 931)

BMS3h-56-17
GAGGTGCAGCTGTTGGAGTCTGGGGGAGGCTTGGTACAGCCTGGGGGGTCCCTGCGTCTCTCCTGTGCAGCCTCCGGAT
TCTCCTTTCGGGATTATGAGATGTGGTGGTACCGCCAGGCTCCAGGGAAGGGTCTAGAGCGGGTCTCAGCTATTAATCC
GCAGGGTACGCGTACATATTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTACTTTTGAGGACT
GGGGTCAGGGAACCCTGGTCACCGTCTCGAGC (SEQ ID NO: 932)

BMS3h-56-18
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGTTCTAGAGCGGGTCTCAGCTATTAATCC
GCAGGGTACGCGTACATACTACGCAGACTCCGTGAAGGGCCGGTTCACCATCTCCCGCGACAATTCCAAGAACATGCTG
TATCTGCAAATGAACAGCCTGCGTGCCGAGGACACCGCGGTATATTACTGTGCGAAACTTCCGTTTACTTTTGAGGACT
GGGGTCAGGGAACCCTGGTCACCGTCTCGAGC (SEQ ID NO: 933)

BMS3h-56-19
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATCACTGTGCGAAACTTCCGTTTACTTTTGAGGACT
GGGGTCAGGGAACCCTGGTCACCGTCTCGAGC (SEQ ID NO: 934)

BMS3h-56-20
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTACGAAACTTCCGTTTACTTTTGAGGACT
GGGGTCAGGGAACCCTGGTCACCGTCTCGAGC (SEQ ID NO: 935)

BMS3h-56-21
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTTTGAAACTTCCGTTTACTTTTGAGGACT
GGGGTCAGGGAACCCTGGTCACCGTCTCGAGC (SEQ ID NO: 936)

BMS3h-56-22
GAGGTGCAGCTGTTGGAGTCTGGGGGAGGCTTGGTACAGCCTGGGGGGTCCCTGCGTCTATCCTGTGCAGCCTCCGGAT
TCACCTTTCGGGATTATGAGATGTGGTGGGTCCGCCAGGCTCCAGGGAAGGGTCTAGAGCGGGTCTCAGCTATTAACCC
GCAGGGTACGCGTACATACTATGCAGACTCCGTGAAGGGCCGGTTCACCATCTCCCGCGACAATTCCAAGAACACGCTG
TATCTGCAAATGAACAGCCTGCGTGCCGATGATACCGCGGTATATCACTGTACGAAACTTCCGTTTATTTTTGAATACT
GGGGTCAGGGAACCCTGGTCACCGTCTCGAGC (SEQ ID NO: 937)

BMS3h-56-23
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGACACCGCGGTATATTACTGTGCGAAAGAACCTTATAGTTTTGACTCCT
GGGGTCAGGGAACCCTGGTCACCGTCTCGAGC (SEQ ID NO: 938)

TABLE 4-continued

Human Anti-CD40 Variable Domain Encoding Nucleotide Sequences

```
BMS3h-56-24
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACCGCGGTATATCACTGTGCGAAAGAACCTTATAGTTATGACTACT
GGGGTCAGGGAACCCTGGTCACCGTCTCGAGC (SEQ ID NO: 939)

BMS3h-56-25
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCGGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 940)

BMS3h-56-26
GAGGTGCAGCTGTTGGAGTCTGGGGGAGGCTTGGTACAGCCTGGGGGGTCCCTGCGTCTATCCTGTGCAGCCTCCGGAT
TCACCTTTCGGGATTATGAGATGTGGTGGGTCCGCCGGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACTGCGGTATATTACTGTGCGAAACTTCCGTTTATGTTTGACGACC
GGGGTCAGGGAACCCTGGTCACCGTCTCGAGC (SEQ ID NO: 941)

BMS3h-56-27
GAGGTGCAGCTGTTGGAGTCTGGGGGAGGCTTGGTACAGCCTGGGGGGTCCCTGCGTCTATCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACTGCGGTATATTACTGTGCGAAACTTCCGTTTATGTTTGACGACT
GGGGTCAGGGAACCCTGGTCACCGTCTCGAGC (SEQ ID NO: 942)

BMS3h-56-28
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGTTGTGGTGGGTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 943)

BMS3h-56-29
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGTTGTGGTGGGTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACTGCGGTATATTACTGTGCGAAACTTCCGTTTATGTTTGACGACC
GGGGTCAGGGAACCCTGGTCACCGTCTCGAGC (SEQ ID NO: 944)

BMS3h-56-30
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGTTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 945)

BMS3h-56-31
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGTTCCGCCAGGCTCCAGGGAAGGGTCTAGAGCGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACTGCGGTATATTACTGTGCGAAACTTCCGTTTATGTTTGACGACC
GGGGTCAGGGAACCCTGGTCACCGTCTCGAGC (SEQ ID NO: 946)

BMS3h-56-32
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGTGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 947)

BMS3h-56-33
GAGGTGCAGCTGTTGGAGTCTGGGGGAGGCTTGGTACAGCCTGGGGGGTCCCTGCGTCTATCCTGTGCAGCCTCCGGAT
TCACCTTTCGGGATTATGAGATGTGGTGGGTCCGCCAGGCTCCAGGGAAGGGTCTAGAGTGGGTCTCAGCTATTAATCC
GCAGGGTACGCGTACATACTACGCAGACTCCGTGATGGGCCGGTTCACCATCTCCCGCGACAATTCCAAGAACACGCTG
TATCTGCAAATGAACAGCCTGCGTGCCGAGGATACTGCGGTATATTACTGTGCGAAACTTCCGTTTATGTTTGACGACC
GGGGTCAGGGAACCCTGGTCACCGTCTCGAGC (SEQ ID NO: 948)

BMS3h-56-202
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGACCTACTTTTCCGACC
GGGGTCAGGGAACCCTGGTCACCGTCTCGAGC (SEQ ID NO: 949)
```

TABLE 4-continued

Human Anti-CD40 Variable Domain Encoding Nucleotide Sequences

BMS3h-56-203
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTTCTTTGAGGAGT
GGGGTCAGGGAACCCTGGTCACCGTCTCGAGC (SEQ ID NO: 950)

BMS3h-56-204
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGACGTACTTTAAGGACT
GGGGTCAGGGAACCCTGGTCACCGTCTCGAGC (SEQ ID NO: 951)

BMS3h-56-205
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTACTTTTCCGAGT
GGGGTCAGGGAACCCTGGTCACCGTCTCGAGC (SEQ ID NO: 952)

BMS3h-56-206
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATCACTGTGCGAAACTTCCGATGTTCTTTGAGGACT
GGGGTCAGGGAACCCTGGTCACCGTCTCGAAC (SEQ ID NO: 953)

BMS3h-56-207
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTCCGTTTTCGGAGT
GGGGTCAGGGAACCCTGGTCACCGTCTCGAGC (SEQ ID NO: 954)

BMS3h-56-208
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGGACAGCCTGCGTGCCGAGGACACCGCGGTATATTACTGTGCGAAACTTCCGTTTTACTTTTCCGAGT
GGGGTCAGGGAACCCTGGTCACCGTCTCGAGC (SEQ ID NO: 955)

BMS3h-56-209
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTACGGTAACCTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 956)

BMS3h-56-210
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCCCGGTACCTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACC
GGGGTCAGGGAACCCTGGTCACCGTCTCGAGC (SEQ ID NO: 957)

BMS3h-56-211
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGCTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 958)

BMS3h-56-212
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GATGGGTGGGTTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 959)

BMS3h-56-213
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTTCGCACACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 960)

TABLE 4-continued

Human Anti-CD40 Variable Domain Encoding Nucleotide Sequences

BMS3h-56-214
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTCCGGTGGGCTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACC
GGGGTCAGGGAACCCTGGTCACCGTCTCGAGC (SEQ ID NO: 961)

BMS3h-56-215
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCACGGTTCGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 962)

BMS3h-56-216
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GGCCGGTCGGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 963)

BMS3h-56-217
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTAGCTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 964)

BMS3h-56-218
GAGGTGCAGCTGTTGGAGTCTGGGGGAGGCTTGGTACAGCCTGGGGGGTCCCTGCGTCTCTCCTGTGCAGCCTCCGGAT
TCACCTTTCCCGACTACGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATCACTGTGCGAAACTTCCGTTTACTTTTGACGACT
GGGGTCAGGGAACCCTGGTCACCGTCTCGAGC (SEQ ID NO: 965)

BMS3h-56-219
GAGGTGCAGCTGTTGGAGTCTGGGGGAGGCTTGGTACAGCCTGGGGGTCCCTGCGTCTCTCCTGTGCAGACTCCGGAT
TCACCTTTCCGCCCGTGGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 966)

BMS3h-56-220
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTACGGTGGGCTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 967)

BMS3h-56-221
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTAACCACAGATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 968)

BMS3h-56-222
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCACGGTGGCTACACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 969)

BMS3h-56-223
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAGGGGTCTAGAGCGGGTCTCAGCTATTAATCC
GCCCGGTATGCTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 970)

BMS3h-56-224
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTCAGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 971)

TABLE 4-continued

Human Anti-CD40 Variable Domain Encoding Nucleotide Sequences

BMS3h-56-225
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGCTACACATACTACGCAGACTCCGTGAAGGGCCGATTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 972)

BMS3h-56-226
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTCGGGTGGGCTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 973)

BMS3h-56-227
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTCGGGTGGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 974)

BMS3h-56-228
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTCGGGTACGCTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 975)

BMS3h-56-229
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTACGGTTCGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 976)

BMS3h-56-230
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGCTACACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 977)

BMS3h-56-231
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTGGGCTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 978)

BMS3h-56-232
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTTCCCACACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 979)

BMS3h-56-233
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTACCTTGACATACTACGCAGACTCCGTGAAGGGCCGGTTCACCATCTCCCGCGACAATTCCAGGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 980)

BMS3h-56-234
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GAACGGTCGGCTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGCGGACT
GGGGTCAGGGAACCCTGGTCACCGTCTCGAGC (SEQ ID NO: 981)

BMS3h-56-235
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTCAGCTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 982)

TABLE 4-continued

Human Anti-CD40 Variable Domain Encoding Nucleotide Sequences

BMS3h-56-236
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCACGGTGGCCTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 983)

BMS3h-56-237
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTGGAGCGGGTCTCAGCTATTAATCC
GGCGGGTATGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 984)

BMS3h-56-238
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCACGGTACCTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 985)

BMS3h-56-239
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTTCGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 986)

BMS3h-56-240
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTACGGTGGCCTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 987)

BMS3h-56-241
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTACGAGATGTGGTGGGTCCGCCAGGCTCCAGGGAAGGGTCTAGAGCGGGTCTCAGCTATTAATCC
GGCCGGTTTCTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 988)

BMS3h-56-242
GAGGTGCAGCTGTTGGAGTCTGGGGGAGGCTTGGTACGGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTGGAGCGGGTCTCAGCTATTAATCC
GTACGGTGGCCTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 989)

BMS3h-56-243
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 990)

BMS3h-56-244
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 991)

BMS3h-56-245
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTACGGTGGCTGACATACTACGCAGACTCCGTGAAGGGCCGGTTCACCATCTCCCGCGACAATTCCAAGAACACGCTG
TATCTGCAAATGGACAGCCTGCGTGCCGAGGATAGCGCGGTATATTACTGTGCGAAACTTCCGTTTACTTTTGAGGACT
GGGGTCAGGGAACCCTGGTCACCGTCTCGAGC (SEQ ID NO: 992)

BMS3h-56-246
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTACGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 993)

TABLE 4-continued

Human Anti-CD40 Variable Domain Encoding Nucleotide Sequences

BMS3h-56-247
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGCTACACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCGGGGAACCCTGGTCACCGTCTCGAGC (SEQ ID NO: 994)

BMS3h-56-248
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTACGGTAACCTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 995)

BMS3h-56-249
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCACGGTGGGTTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 996)

BMS3h-56-250
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GGCCGGTTTCTACACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 997)

BMS3h-56-251
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GGCGGGTGGCCTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGACGACT
GGGGTCAGGGAACCCTGGTCACCGTCTCGAGC (SEQ ID NO: 998)

BMS3h-56-252
GAGGTGCAGCTGTTGGAGTCTGGGGGAGGCTTGGTACAGCCTGGGGGGTCCCTGCGTCTCTCCTGTGCAGCCTCCGGAT
TCGCCTTTCGGGATTATGAGATGTGGTGGGTCCGCCAGGCTCCAGGGAAGGGTCTAGAGCGGGTCTCAGCTATTAATCC
GCACGGTTCCCTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTACTTTTGAGGACT
GGGGTCAGGGAACCCTGGTCACCGTCTCGAGC (SEQ ID NO: 999)

BMS3h-56-253
GAGGTGCAGCTGTTGGAGTCTGGGGGAGGCTTGGTACAGCCTGGGGGGTCCCTGCGTCTCTCCTGTGCAGCCTCCGGAT
TCACCTTTCGTGATTATGAGATGTGGTGGGTCCGCCAGGCTCCAGGGAAGGGTCTAGAGCGGGTCTCAGCTATTAATCC
GGCCGGTGGGTACACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATCACTGTGCGAAACTTCCGTTTACTTTTGAGGACT
GGGGTCAGGGAACCCTGGTCACCGTCTCGAGC (SEQ ID NO: 1000)

BMS3h-56-254
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTGGTTTACGGAGT
GGGGTCAGGGAACCCTGGTCACCGTCTCGAGC (SEQ ID NO: 1001)

BMS3h-56-255
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTCATGTTTTCCGACC
GGGGTCAGGGAACCCTGGTCACCGTCTCGAGC (SEQ ID NO: 1002)

BMS3h-56-256
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTTGTTTCAGGAGT
GGGGTCAGGGAACCCTGGTCACCGTCTCGAGC (SEQ ID NO: 1003)

BMS3h-56-257
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGACGCGGTTTGAGGACT
GGGGTCAGGGAACCCTGGTCACCGTCTCGAGC (SEQ ID NO: 1004)

TABLE 4-continued

Human Anti-CD40 Variable Domain Encoding Nucleotide Sequences

BMS3h-56-258
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTACTTTCACGAGT
GGGGTCAGGGAACCCTGGTCACCGTCTCGAGC (SEQ ID NO: 1005)

BMS3h-56-259
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGGGAAAGAGCCGTTTCGTTATGACTACT
GGGGTCAGGGAACCCTGGTCACCGTCTCGAGC (SEQ ID NO: 1006)

BMS3h-56-260
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGACGTTCTTTAAGGACT
GGGGTCAGGGAACCCTGGTCACCGTCTCGAGC (SEQ ID NO: 1007)

BMS3h-56-261
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACACGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTTTCTTTCAGGAGT
GGGGTCAGGGAACCCTGGTCACCGTCTCGAGC (SEQ ID NO: 1008)

BMS3h-56-262
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGCAGTTGTTTCACGACC
GGGGTCAGGGAACCCTGGTCACCGTCTCGAGC (SEQ ID NO: 1009)

BMS3h-56-263
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGCAGCTCTTTGAGGACT
GGGGTCAGGGAACCCTGGTCACCGTCTCGAGC (SEQ ID NO: 1010)

BMS3h-56-264
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATCACTGTGCGAAACTTCCGTTTGGGTTTTCCGAGT
GGGGTCAGGGAACCCTGGTCACCGTCTCGAGC (SEQ ID NO: 1011)

BMS3h-56-265
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGCAGTTGTTTCAGGACT
GGGGTCAGGGAACCCTGGTCACCGTCTCGAGC (SEQ ID NO: 1012)

BMS3h-56-266
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTTCTTTCACGAGT
GGGGTCAGGGAACCCTGGTCACCGTCTCGAGC (SEQ ID NO: 1013)

BMS3h-56-267
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGCACTACTTTAAGGACT
GGGGTCAGGGAACCCTGGTCACCGTCTCGAGC (SEQ ID NO: 1014)

BMS3h-56-268
GAGGTGCAGCTGTTGGAGTCTGGGGGAGGCTTGGTACAGTCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTTACTTTGAGGAGT
GGGGTCAGGGAACCCTGGTCACCGTCTCGAGC (SEQ ID NO: 1015)

TABLE 4-continued

Human Anti-CD40 Variable Domain Encoding Nucleotide Sequences

BMS3h-56-269
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTAGGTTTTCCGACC
GGGGTCAGGGAACCCTGGTCACCGTCTCGAGC (SEQ ID NO: 1016)

BMS3h-56-270
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGACGCTGTTTCAGGACT
GGGGTCAGGGAACCCTGGTCACCGTCTCGAGC (SEQ ID NO: 1017)

BMS3h-56-271
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTACTTTTCCGAGT
GGGGTCAGGGAACCCTGGTCACCGTCTCGAAC (SEQ ID NO: 1018)

BMS3h-56-272
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTGGTTTCAGGAGT
GGGGTCAGGGAACCCTGGTCACCGTCTCGAGC (SEQ ID NO: 1019)

BMS3h-56-273
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTTCGTTGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTACTTTCAGGAGT
GGGGTCAGGGAACCCTGGTCACCGTCTCGAGC (SEQ ID NO: 1020)

BMS3h-56-274
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTTCGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATCACTGTGCGAAACTTCCGATGTTCTTTGAGGACT
GGGGTCAGGGAACCCTGGTCACCGTCTCGAAC (SEQ ID NO: 1021)

BMS3h-56-275
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTTCGTTGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTACTTTCACGAGT
GGGGTCAGGGAACCCTGGTCACCGTCTCGAGC (SEQ ID NO: 1022)

BMS3h-56-276
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTTCGTTGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTTCTTTCAGGAGT
GGGGTCAGGGAACCCTGGTCACCGTCTCGAGC (SEQ ID NO: 1023)

BMS3h-56-277
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTTCGTTGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTTCTTTCACGAGT
GGGGTCAGGGAACCCTGGTCACCGTCTCGAGC (SEQ ID NO: 1024)

BMS3h-56-278
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTTACTTTCAGGAGT
GGGGTCAGGGAACCCTGGTCACCGTCTCGAGC (SEQ ID NO: 1025)

BMS3h-56-279
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATCACTGTGCGAAACTTCCGATGTTCTTTGAGGACT
GGGGTCAGGGAACCCTGGTCACCGTCTCGAAC (SEQ ID NO: 1026)

TABLE 4-continued

Human Anti-CD40 Variable Domain Encoding Nucleotide Sequences

BMS3h-56-280
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTCACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTACTTTCACGAGT
GGGGTCAGGGAACCCTGGTCACCGTCTCGAGC (SEQ ID NO: 1027)

BMS3h-56-281
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTCACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTTCTTTCAGGAGT
GGGGTCAGGGAACCCTGGTCACCGTCTCGAGC (SEQ ID NO: 1028)

BMS3h-56-282
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTTTCTTTCACGAGT
GGGGTCAGGGAACCCTGGTCACCGTCTCGAGC (SEQ ID NO: 1029)

BMS3h-56-283
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTTACTTTCAGGAGT
GGGGTCAGGGAACCCTGGTCACCGTCTCGAGC (SEQ ID NO: 1030)

BMS3h-56-284
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATCACTGTGCGAAACTTCCGATGTTCTTTGAGGACT
GGGGTCAGGGAACCCTGGTCACCGTCTCGAAC (SEQ ID NO: 1031)

BMS3h-56-285
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTGACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAACTTCCGTTTTACTTTCACGAGT
GGGGTCAGGGAACCCTGGTCACCGTCTCGAGC (SEQ ID NO: 1032)

BMS3h-56-286
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTTTCTTTCAGGAGT
GGGGTCAGGGAACCCTGGTCACCGTCTCGAGC (SEQ ID NO: 1033)

BMS3h-56-287
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GTGGGGTGGGTTGACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAACTTCCGTTTTTCTTTCACGAGT
GGGGTCAGGGAACCCTGGTCACCGTCTCGAGC (SEQ ID NO: 1034)

BMS3h-56-288
GAGGTGCAGCTGTTGGAGTCTGGGGGAGGCTTGGTACAGCCTGGGGGGTCCCTGCGTCTCTCCTGTGCAGCCTCCGGAT
TCACCTTTCGGGATTATGAGATGTGGTGGGTCCGCCAGGCTCCAGGGAAGGGTCTAGAGCGGGTCTCAGCTATTAATCC
GCAGGGTACGCGTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATCACTGTGCGAAACTTCCGATGTTCTTTGAGGACT
GGGGTCAGGGAACCCTGGTCACCGTCTCCAGC (SEQ ID NO: 1035)

BMS3h-106-1
GAGGTGCAGCTGTTGGAGACTGGGGGAGGCTTGGTACAGCCTGGGGGGTCCCTGCGTCTCTCCTGTGCAGCCTCCGGAT
TCACCTTTTCGACTTATCATATGCAGTGGGTCCGCCGGGCTCCAGGGAAGGGCCTGGAGTGGGTCTCAATGATTGATGC
GGATGGTCTTGGGACATACTACGCAGACCCCGTGAAGGGCCGGTTCACCATCTCCCGCGACAATTCCAAGAACACGCTG
TATCTGCAAATGAACAGCCTGCGTGCCAAGGACACCGCGGTATATTACTGTGCGAGACCGGGTCCGCAGTTTGGTCAGT
TTGACTACTTGGGTCAGGGAACCCTGGTCACCGTCTCGAGC (SEQ ID NO: 1036)

BMS3h-106-2
GAGGTGCAGCTGTTTGAGTCTGGGGGAGGCTTGGTACAGACTGGGGGGTCCCTGCGTCTCTCCTGTGCAGCCTCCGGAT
TCACCTTTTCGACTTATCATATGCAGTGGGTCCGCCAGGCTCCAGGGAAGGGTCTGGAGTGGGTCTCAATGATTGATGC
GGATGGTCTTGGGAAATACTACGCAGACCCCGTGAAGGGCCGGTTCACCATCTCCCGCGACAATTCCAAGAACACGCTG
TATCTGCAAATGAACAGCCTGCGTGCCGAGGACACCGCGGTATATTACTGTGTGAAACCGGGTCCGCAGTTTGGTCAGT
ATGACTACTGGGGTCAGGGAACCCTGGTCACCGTCTCGAGC (SEQ ID NO: 1037)

TABLE 4-continued

Human Anti-CD40 Variable Domain Encoding Nucleotide Sequences

BMS3h-107-1
GAGGTGCAGCTGTTGGAGTCAGGGGGAGGCTTGGTACAGCCTGGGGGGTCCCTGCGGCTCTCCTGTTCAGCTTCCGGAT
TCACCTTTTCGGGGTATGATATGCAGTGGGTCCGCCAGGCTCCAGGGAAGGGTCTAGAGTGGGTCTCAACGATTAGTGC
GTCGGGTGTTTATACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAATATCCTAATCGTTTTGCGCTTA
ATAGTTTTGACTACAGGGGTCGGGGAACCCTGGTCACCGTCTCGAGC (SEQ ID NO: 1038)

BMS3h-107-2
GAGGTGCAGCTGTTGGAGTCTGGGGGAGGCTTGGTACAGCCTGGGGGGTCCCTGCGTCTCTCCTGTGCAGCTTCCGGAT
TCACCTTTTCGGGGTATGATATGCAGTGGGTCCGCCAGGCTCCAGGGAGGGGTCTAGAGTGGGTCTCAACGATTAGTGC
GTCGGGTGTTTATACATACTACACAGACTCCGTGAAGGGCCGGTTCACCACCTCCCGCGACAATTCCAAGAACACGCTG
TATCTGCAAATGAACAGCCTGCGTGCCGAGGACACCGCGGTATATTACTGTACGAAATATCCAAATCGTTTTGCGCGTA
ATAATTTTGACTACTGGGGTCAGGGAACCCTGGTCACCGTCTCGAGC (SEQ ID NO: 1039)

BMS3h-131-1
GACATCCTGATGACCCAGTCTCCATCCTCCCTGTCTGCATCTGTAGGAGACCGTGTCACCATCACTTGCCGGGCAAATA
GTTCTATTTTGTGGGCGTTAGCTTGGTACCAGCAGAAACCAGGGGAAGCCCCTAAGCTCCTGATCGAGAGTTCTTCCGG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCAGCCAAGGGACCAAGGTGGAAA
TCAAACGG (SEQ ID NO: 1040)

BMS3h-131-2
GACATCCAGATGACCCAGTCTCCATCCTCCCTGTCTGCATCTGTAGGAGACCGTGTCACCATCACTTGCCGGGCAGACA
GTTCTATTTTGTGGGCGTTAGCTTGGTACCAGCAGAAACCAGGGAAAGCCCCTAAGCTCCTGATCGAGAGTTCATCCGG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAAA
TCAAACGG (SEQ ID NO: 1041)

BMS3h-131-3
GACATCCAGATGACCGTGTCTCCATCCTCCCTGTCTGCATCTGTAGGAGACCGTGTCACCATCACTTGCCGGGCAGATA
GTTCTATTTTGTGGGCGTTAGCTTGGTACCAGCAGAAACCAGGGAAAGCCCCTAAGCTCCTGATCGAGAGTTCTTCCGG
ATTGCAAAGCGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAAA
TCAAACGG (SEQ ID NO: 1042)

BMS3h-131-4
GACATCCAGATGACCCAGTCTCCATCCTCCCTGTCTGCATCTGTAGGAGACCGTGTCACCATCACTTGCCGGGCAAATA
GTTCTATTTTGTGGGCGTTAGCTTGGTACCAGCAGAAACCAGGGAAAGCCCCTAAGCTCCTGATCGAGAGTTCTTCCGG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGACCAAGGGACCAAGGTGGAAA
TCAAACGG (SEQ ID NO: 1043)

BMS3h-131-5
GACATCCAGATGACCCAGTCTCCATCCTCCCTGTCTGCATCTGTAGGAGACCGTGTCACCATCACTTGCCGGGCAAATA
GTTCTATTTTGTGGGCGTTAGCTTGGTACCAGCAGAAACCAGGGAAAGCCCCTAAGCTCCTGATCGAGAGTTCTACCGG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAAA
TCAAACGG (SEQ ID NO: 1044)

BMS3h-131-6
GACATCCAGATGACCGTGTCTCCATCCTCCCTGTCTGCATCTGTAGGAGACCGTGTCACCATCACTTGCCGGGCAAATA
GTTCTATTTTGTGGGCGTTAGCTTGGTACCAGCAGAAACCAGGGAAAGCCCCTAAGCTCCTGATCGAGAGTTCTTCCGG
ATTGCAAAGCGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAAA
TCAAACGG (SEQ ID NO: 1045)

BMS3h-131-7
GACATCCAGATGACCCAGTCTCCATCCTCCCTGTCTGCATCTGTAGGAGACCGTGTCACCATCACTTGCCGGGCAGATA
GTTCTATTTTGTGGGCGTTAGCTTGGTACCAGCAGAAACCAGGGAAAGCCCCTAAGCTCCTGATCGAGAGTTCTTCCGG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGACCAAGGGACCAAGGTGGAAA
TCAAACGG (SEQ ID NO: 1046)

BMS3h-131-8
GACATCCAGATGACCCAGTCTCCATCCTCACTGTCTGCATCTGTAGGAGACCGTGTCACCATCACTTGCCGGGCAAATA
GTTCTATTTTGTGGGCGTTAGCTTGGTACCAGCAGAAACCAGGGAAAGCCCCTGAGCTCCTGATCGAGAGTTCTTCCGG
TCTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAAA
TCAAACGG (SEQ ID NO: 1047)

BMS3h-131-9
GACATCCAGATGACCCAGTCTCCATCCTCCCTGTCTGCATCTGTAGGAGACCGTGTCACCATCACTTGCCGGGCGAATA
GTTCTATATTGTGGGCGTTGGCTTGGTACCAGCAGAAACCAGGGAAAGCCCCTAAGCTCCTGATCGAGAGTTCTTCCGG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAAA
ACAAACGG (SEQ ID NO: 1048)

TABLE 4-continued

Human Anti-CD40 Variable Domain Encoding Nucleotide Sequences

BMS3h-131-10
GACATCCAGATGACCCAGTCTCCATCCTCCCTGTCTGCATCTGTAGGAGACCGTGTCACCATCACTTGCCGGGCAAATA
GTTCTATTCTGTGGGCGTTAGCTTGGTACCAGCAGAAACCTGGGAAAGCCCCTAAGCTCCTGATCGAGAGTTCTTCCGG
TTTGCAAAGTGGGGTCCCATCACGTTTCAGTGGCAGTGGATCTGGGACAGATTTCACTCTCACCATCAGCAGTCTGCAA
CCCGAAGATTTTGCTACGTACTACTGTGTTCAGAATGCGGTTTGGCCTGGTACGTTCGGCCAAGGGACCAAGGTGGAAA
TCAAACGG (SEQ ID NO: 1049)

BMS3h-131-11
GACATCCAGATGACCCAGTCTCCATCCTCCCTGTCTGCTTCTGTAGGAGACCGTGTCACCATCACTTGCCGGGCAAATA
GTTCTATTTTGTGGGCGTTAGCTTGGTACCAGCAGAAACCAGGGAAAGCCCCTAAGCTCCTGATCGAGAGTTCTTCCGG
TTTGCAAAGTGGGATCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAAA
TCAAACGG (SEQ ID NO: 1050)

BMS3h-131-12
GACATCCAGATGACCCAGTCTCCATCCTCCCTGTCTGCATCTGTTGGAGACCGTGTCACCATCACTTGCCGGGCAAATA
GTTCTATTTTGTGGGCGTTAGCTTGGTACCAGCAGAAACCAGGGAAAGCCCCTAAGCTCCTGATCGAGAGTTCTTCCGG
ATTGCAAAGCGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAAA
TCAAACGG (SEQ ID NO: 1051)

BMS3h-131-13
GACATCCTGTTGACCCAGTCTCCATCCTCCCTGTCTGCATCTGTAGGAGACCGTGTCACCATCACTTGCCGGGCAAATA
GTTCTATTTTGTGGGCGTTAGCTTGGTACCAGCAGAAACCAGGGAAAGCCCCTAAGCTCCTGATCGAGAGTTCTTCCGG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAAA
TCAAACGG (SEQ ID NO: 1052)

BMS3h-131-14
GACATCCAGATGACCCAGTCTCCATCCTCCCTGTCTGCATCTGTAGGAGACCGTGTCACCATCACTTGCCGGGCAAATA
GTTCTATTTTGTGGGCGTTAGCTTGGTACCAGCAGAAACCAGGGAAAGCCCCTAAGCTCCTGATCGAGAGTTCTTCCGG
TTTGCAAAGTGGGGTCCCATCACGTTTCAGTGGAAGTGGAACTGGGACAGATTTCACTCTCACCATCAGCGGTCTGCAA
CCTGAAGATTTTGCTACGTACTACTGTGTTCAGAATGCGGTTTGGCCTGGTACGTTCGACCAAGGGACCAAGGTGGAAA
TCAAACGG (SEQ ID NO: 1053)

BMS3h-131-15
GACATCCAGATGACCCAGTCTCCATCCTCCCTGTCTGCATCTGTAGGAGACCGTGTCACCATCCCTTGCCGGGCAAATA
GTTCTATTTTGTGGGCGTTAGCTTGGTACCAGCAGAAACCAGGGAAAGCCCCTAAGCTCCTGATCGAGAGTTCTTCCGG
TTTGCAAAGTGGGGTCCCATCACGTTTCAGTGGCAGTGCATCTGGGACAGATTTCACTCTCACCATCAGCAGTCTGCAA
CCTGAAGATTTTGCTACGTACTACTGTGTTCAGAATGCGGTTTGGCCTGGTACGTTCGGCCAAGGGACCAAGGTGGAGA
TCAAACGG (SEQ ID NO: 1054)

BMS3h-193-1
GACATCCAGATGGCCCAGTCTCCATCCTCCCTGTCTGCATCTGTAGGAGACCGTGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGCGAGTCCACCTTTGACGTTAGGCCAAGGGACCAAAGTGGAAA
TCAAACGG (SEQ ID NO: 1055)

BMS3h-193-2
GACATCCAGATGACCCAGTCTCCATCCTCCCTGTCTGCATCTGTAGGAGACAGTGTCACCATCACTTGCCGGGCAAGTC
AGACGATTGAGCGTCGTTTAAATTGGTATCAGCAGAAACCAGGGGAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGCCATCAGTATGCGAGTCCACCTTTGACGTTCGGCCAAGGGACCAATGTGGAAA
TCAAACGG (SEQ ID NO: 1056)

BMS3h-193-3
GACATCCAGATGACCCAGTCTCCATCCTCCCTATCTGCATCTGTAGGAGACCGTGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTGCGTACTACTGTCATCAGTACGAGAGTCCACCTTTGACGTTTGGCCAAGGGACCAAAGTGGAAA
TCAAACGG (SEQ ID NO: 1057)

BMS3h-193-4
GACATCCAGATGACCCAGTCTCCATCCTCCCTGTCTGCATCTGTAGGAGACCGTGTCACCATCACTTGCCGGGCAAGTC
GGACGATTGAGCGTCGTTTAAATTGGTATCAGCAGAAACCAGGGAAAGCCCCTAAGCTCCTGATCTATCTTGCTTCGCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1058)

BMS3h-193-5
GACATCCAGATGACCCAGTCTCCATCCTCCCTGTCTGCATCTGTAGGAGAACGTGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAATCTGCAA
CCTGAAGATTCTGCTACGTACTACTGTCATCAGTATGCGAGTCCACCTTTGACGTTAGGCCAAGGGACCAAAGTGGAAA
TCAAACGG (SEQ ID NO: 1059)

TABLE 4-continued

Human Anti-CD40 Variable Domain Encoding Nucleotide Sequences

BMS3h-193-6
GACATCCAGATGACCCAGTCTCCATCCTCCCTGTCTGCATCTGTAGGAGACCGTGTCACCATCACTTGCCGGGCAAGCC
AGACGATTGAGCGTCGTTTAAATTGGTATCAGCAGAAACCAGGGAAGGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGCGAGTCCACCTTTGACGTTAGGCCAAGGGACCAAAGTGGAAA
TCAAACGG (SEQ ID NO: 1060)

BMS3h-193-7
GACATCCAGATAACCCAGTCTCCATCCTCCCTGTCTGCATCTGTAGGAGACCGTGTCACCATCACTTGCCGGGCAAGTC
AGACGATTGAGCGTCGTTTAAATTGGTATCAGCAGAAACCAGGGAAAGACCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCTCCTTTGACGTTCGGCCAAGGGACCAAAGTGGAAA
TCAAACGG (SEQ ID NO: 1061)

BMS3h-193-8
GACATCCAGATGACCCAGTCTCCATCCTCCCTGTCTGCATCTGTAGGAGACCGTGTCACCATCACTTGCCGGGCAAGTC
AGACGATTGAGCGTCGTTTAAATTGGTATCAGCAGAAACCAGGGGAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAATGG (SEQ ID NO: 1062)

BMS3h-193-9
GACATCCAGTTGACCCAGTCTCCATCCTCCCTGTCTGCATCTGTAGGAGACCGAGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGAATTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1063)

BMS3h-193-10
GACATCCAGATGTCCCAGTCTCCATCCACCCTGTCTGCATCTGTAGGAGACCGTGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
CTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGATGTTCGGCCAAGGGACCAAAGTGGAAA
TCAAACGG (SEQ ID NO: 1064)

BMS3h-193-11
GACATCCAGATGACCCAGTCTCCATCCTCCCTGTCTGCATCTGTAGGAGACCGTGTCACCATTACTTGCCGGGCAAGTC
AGACGATTGAGCGTCGTTTAAATTGGTATCAGCAGAAACCAGGGAAAGACCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCAGAAGATTTTGCTACGTACTACTGTCATCAGTATGAGAGTCCACCTTTGACGTTCGGCCAAGGGACCAAAGTGGAAA
TCAAACGG (SEQ ID NO: 1065)

BMS3h-193-12
GACATCCAGATGACCCAGTCTCCATCCTCCCTGTCTGCATCCGTAGGAGACCGTGTCACCATCACTTGCCGGGCAAGTC
AGACGATTGAGCGTCGTTTAAACTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1066)

BMS3h-193-13
GACATCCAGATGACCCAGTCTCCATCCTCCCTGTTTGCATCTGTAGGGGACCGTGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1067)

BMS3h-193-14
GACATCCAGATGACCCAGTATCCATCCTCCCTGTCTGCATCTGTAGGAGACCGTGTCACCATCACTTGCCGGGCAAGTC
AGTCGATTGAGCGTCGTTTAAATTGGTATCAGCAGAAACCAGGGGAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACTAAAGTGGAAA
TCAAACGG (SEQ ID NO: 1068)

BMS3h-193-15
GACATCCAGATGACCCAGTCTCCATCCTCCCTGTCTGCATCTGTAGGAGACCGTGTCACCATCACTTGCCGGGCAAGTC
GGACGATTGAGCGTCGTTTAAATTGGTATCAGCAGAAACCAGGGAAAGCCCCTAAGCTCCTGATCTATCTTGCTTCGCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCCGTATGAGAGTCCACCTTTGACGTTCGGCCAAGGGACCAAAGTGGAAA
TCAAACGG (SEQ ID NO: 1069)

BMS3h-193-16
GACATCCAGATGACCCAGTCTCCATCCTCCCTGTCTGCATCTGTAGGAGACCGTGTCACCATCACTTGCCGGGCAAGTC
AGGCGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCCGTTTCAGTGGCAGTGGATCTGGGACAGATTTCACTCTCACCATCAGCAGTCTGCAG
CCAGAAGATTTTGCTACGTACTACTGTCATCAGTATGCGAGTCCACCTTTGACGCTCGGCCAAGGGACCAAAGTGGAAA
TCAAACGG (SEQ ID NO: 1070)

TABLE 4-continued

Human Anti-CD40 Variable Domain Encoding Nucleotide Sequences

BMS3h-193-17
AACATCCAGATGACCCAGTCTCCATCCTCCCTGTCTGCATCTGTAGGAGACCGTGTCACCATCACTTGCCGGGCAAGTC
AGGCGATTGAGCGTCGTTTAAATTGGTATCAGCAGAAACCAGGGAAAGCCCCTAAGCTCCTGATCTATCTTGCTTCTCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1071)

BMS3h-193-18
GACATCCAGATGACCCAGTCTCCATCCTCCCTGTCTGCATCTGTAGGAGACCGTGTCACCATCACTTGCCGGGCAAGTC
AGACGATTGGGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGTCAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1072)

BMS3h-193-19
GACATCCAGATGACCCAGTCTCCATCCTCCCTTTCTGCATCTGTAGGAGACCGTGTCACCATCACTTGCCGAGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1073)

BMS3h-193-20
GACATCCAGATGACCCAGACTCCATCCTCCCTGTCTGCATCTGTAGGAGACCGTGTCACCATCACTTGCCGGGCAAGTC
AGACGATTGAGCGTCGTTTAAATTGGTATCAGCAGAAACCAGGGGAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCCACGTACTACTGTCATCAGTATGAGAGTCCACCTTTGACGTTCGGCCAAGGGACCAAAGTGAAAA
TCAAACGG (SEQ ID NO: 1074)

BMS3h-193-21
GACATCCAGATGACCCAGTCTCCATCCTCCCTGTCTGCATCTGTAGGAGACAGTGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCCGAAGATTTTGCTACGTACTACTGTCATCAGTATGAGAGTCCACCTTTGACGTTCGGCCAAGGGACCAAAGTGGAAA
TCAAACGG (SEQ ID NO: 1075)

BMS3h-193-22
CACATCCAGATGACCCAGTCTCCATCCTCCCTGTCTGCATCTGTAGGAGACCGTGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGCCATCAGTATGAGAGTCCACCTTTGACGTTCGGCCAAGGGACCAAAGTGGAAA
TCAAACGG (SEQ ID NO: 1076)

BMS3h-193-23
GACGTCCAGATGACCCAGTCTCCATCCTCCCTGTCTGCATCTGTAGGAGACCGTGTCACCATCACTTGCCGGGCAAGTC
AGACGATTGAGCGTCGTTTAAATTGGTATCAGCAGAAACCAGGGAAAGCCCCTAAGCTCCTGATCTATCTTACTTCCCG
TTTGCAAAGCGGGGTCCCATCACGTTTCAGTGGTAGTGGATCTGGGACAGATTTCACTCTCACCATCAGCAGTCTGCAA
CCTGAAGATTTTGCTACGTACTACTGCCATCAGTATGCGAGTCCACCTTTGACGTTCGGCCAAGGGACCAAGGTGGAAA
TCAAACGG (SEQ ID NO: 1077)

BMS3h-193-24
GACATCCAGATGACCCAGTCGCCATCCTCCCTGTCTGCATCTGTAGGAGACCGTGTCACCATCACTTGCCGGGCAAGTC
AGACGATTGAGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCACCAGTATGAGAGTCCACCTTTGACGTTCGGCCAAGGGACCAAAGTGGTAA
TCAAACGG (SEQ ID NO: 1078)

BMS3h-193-25
GACATCCAGATGACCCAGTCTCCATCCTCCCTGTCTGCATCTGTAGGAGACCGAGTCACCATCACTTGCCGGGCAAGTC
AGACGATTGAGCGTCGTTTAAATTGGTATCAGCAGAAACCTGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1079)

BMS3h-193-26
GACATCCAGATGACCCAGTCTCCATCCTCCCTGTCTGCATCTGTAGGAGACCGTGTCACCATCACTTGCCGGGCAAGTC
AGCCGATTGAGCGTCGTTTAAATTGGTATCAGCAGAAGCCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACATACTACTGTCATCAGTATGAGAGTCCACCTTTGACGTTCGGCCAAGGGACCAAAGTGGAAA
TCAAACGG (SEQ ID NO: 1080)

BMS3h-193-27
GACATCCAGATGACCCAGTCTCCATCCTCCCTGTCTGCATCTGTAGGAGACCGTGTCACCATCACTTGCCGGGCAAGTC
AGACGATTGGGCGTCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1081)

TABLE 4-continued

Human Anti-CD40 Variable Domain Encoding Nucleotide Sequences

BMS3h-193-28
GACATCCAGATGACCCAGTCTCCATCCTCCCTGTCTGCATCTGTAGGAGACCGTGTCACCATCACTTGCCGGGCAAGTC
AGTCGATTGAGCGCCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCTCCTTTGACGTTCGGCCAAGGGACCAAAGTGGAAA
TCATACGG (SEQ ID NO: 1082)

BMS3h-193-29
GACATCCAGATGACCCAGTCTCCATCCTCCCTGTCTGCATCTGTAGGAGACCGAGTCACCATCACTTGCCGGGCAAGTC
AGACGATTGAGCGTCGTTTAAATTGGTATCAGCAGAAACCTGGGAAAGCCCCTAAGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1083)

BMS3h-193-30
GACATCCAGATGACCCAGTCTCCATCCTCCCTGTCTGCATCTGTAGGAGACCGTGTCACCATCACTTGCCGGGCAAGTC
AGTCGATTGAGCGCCGTTTAAATTGGTATCAGCAGAAACCAGGGAAAGCCCCTAAGCTCCTGATCTATCTTGCTTCCCG
TTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTCATCAGTATGAGAGTCCTCCTTTGACGTTCGGCCAAGGGACCAAAGTGGAAA
TCAAACGG (SEQ ID NO: 1084)

BMS3h-193-2501
GACATCCAGATGACCCAGTCTCCATCCTCCCTGTCTGCATCTGTAGGAGACCGAGTCACCATCACTTGCCGGGCAAGTC
AGACGATTGAGCGTCGTTTAAATTGGTATCAGCAGAAACCTGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTTCGAGCACCCACCTTTGACGTTCGGCCAAGGGACCAAAGTGGAAA
TCAAACGG (SEQ ID NO: 1085)

BMS3h-193-2502
GACATCCAGATGACCCAGTCTCCATCCTCCCTGTCTGCATCTGTAGGAGACCGAGTCACCATCACTTGCCGGGCAAGTT
TCCCCATTGACCGTCGTTTAAATTGGTATCAGCAGAAACCTGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1086)

BMS3h-193-2503
GACATCCAGATGACCCAGTCTCCATCCTCCCTGTCTGCATCTGTAGGAGACCGAGTCACCATCACTTGCCGGGCAAGTT
CCACCATTGGCCGTCGTTTAAATTGGTATCAGCAGAAACCTGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1087)

BMS3h-193-2504
GACATCCAGATGACCCAGTCTCCATCCTCCCTGTCTGCATCTGTAGGAGACCGAGTTACCATCACTTGCCGGGCAAGTT
CCCAGATTGGGCGTCGTTTAAATTGGTACCAGCAGAAACCAGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1088)

BMS3h-193-2505
GACATCCAGATGACCCAGTCTCCATCCTCCCTGTCTGCATCTGTAGGAGACCGAGTCACCATCACTTGCCGGGCAAGTG
AGCGGATTGGGCGTCGTTTAAATTGGTATCAGCAGAAACCAGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1089)

BMS3h-193-2506
GACATCCAGATGACCCAGTCTCCATCCTCCCTGTCTGCATCTGTAGGAGACCGAGTCACCATCACTTGCCGGGCAAGTC
AGCAGATTGGCCGCCGTTTAAATTGGTATCAGCAGAAACCTGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1090)

BMS3h-193-2507
GACATCCAGATGACCCAGTCTCCATCCTCCCTGTCTGCATCTGTAGGAGACCGAGTCACCATCACTTGCCGGGCAAGTC
AGCCGATTGCCCGGCGTTTAAATTGGTACCAGCAGAAACCAGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1091)

BMS3h-193-2508
GACATCCAGATGACCCAGTCTCCATCCTCCCTGTCTGCATCTGTAGGAGACCGAGTCACCATCACTTGCCGGGCAAGTG
GGAACATTGGCCGTCGTTTAAATTGGTACCAGCAGAAACCAGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAGCGG (SEQ ID NO: 1092)

TABLE 4-continued

Human Anti-CD40 Variable Domain Encoding Nucleotide Sequences

BMS3h-193-2509
GACATCCAGATGACCCAGTCTCCATCCTCCCTGTCTGCATCTGTAGGAGACCGAGTCACCATCACTTGCCGGGCAAGTC
GGAACATTGACCGTCGTTTAAATTGGTACCAGCAGAAACCAGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1093)

BMS3h-193-2510
GACATCCAGATGACCCAGTCTCCATCCTCCCTGTCTGCATCTGTAGGAGACCGAGTCACCATCACTTGCCGGGCAAGTC
AGAGCATTGGGCGTCGTTTAAATTGGTACCAGCAGAAACCTGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1094)

BMS3h-193-2511
GACATCCAGATGACCCAGTCTCCATCCTCCCTGTCTGCATCTGTAGGAGACCGAGTCACCATCACTTGCCGGGCAAGTC
AGAACATTGGGACGCGTTTAAATTGGTACCAGCAGAAACCAGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1095)

BMS3h-193-2512
GACATCCAGATGACCCAGTCTCCATCCTCCCTGTCTGCATCTGTAGGAGACCGAGTCACCATCACTTGCCGGGCAAGTG
AGGTCATTGGGCGTCGTTTAAATTGGTACCAGCAGAAACCAGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1096)

BMS3h-193-2513
GACATCCAGATGACCCAGTCTCCATCCTCCCTGTCTGCATCTGTAGGAGACCGAGTCACCATCACTTGCCGGGCAAGTG
AGGCGATTGGCCGTCGTTTAAATTGGTATCAGCAGAAACCAGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1097)

BMS3h-193-2514
GACATCCAGATGACCCAGTCTCCATCCTCCCTGTCTGCATCTGTAGGAGACCGAGTCACCATCACTTGCCGGGCAAGTA
CCAGCATTGCGCGTCGTTTAAATTGGTATCAGCAGAAACCTGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1098)

BMS3h-193-2515
GACATCCAGATGACCCAGTCTCCATCCTCCCTGTCTGCATCTGTAGGAGACCGAGTCACCATCACTTGCCGGGCAAGTT
TGAACATTGGGCGTCGTTTAAATTGGTACCAGCAGAAACCAGGGAAAGCCCCTAGGCTCCTGATCTATCTTGCTACCCG
TTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1099)

BMS3h-193-2516
GACATCCAGATGACCCAGTCTCCATCCTCCCTGTCTGCATCTGTAGGAGACCGAGTCACCATCACTTGCCGGGCAAGTC
AGACGATTGAGCGTCGTTTAAATTGGTACCAGCAGAAACCAGGGAAAGCCCCTAGGCTCCTGATCTATCTTTCGTCGAA
GTTGCAAAGTGGGGTCCCATCACGCTTCAGTGGCAGTGGATCTGGGACAGATTTCACTCTCACCATCAGCAGTCTGCAA
CCTGAAGATTTTGCTACGTACTACTGTCATCAGTATGAGAGTCCACCTTTGACGTTCGGCCAAGGGACCAAAGTGGAAA
TCAAACGG (SEQ ID NO: 1100)

BMS3h-198-1
GAGGTGCAGCTGTTGGAGTCTGGGGGAGGCTTGGTTCAGCCTGGGGGGTCCCTGCGTCTCTCCTGTGCAGCCTCCGGAT
CCACCATTGCTGGGTATGAGATGTGGTGGGTCCGCCAGGCTCCAGGGAAGGGTCTAGAGCGTGTCTCAGCTATTAGTGG
TAGTGGTGGTAGCACATACTACGCAGACTCCGTGAAGGGCCGGTTCACCATCTCCCGAGACGATTCCAAGAACACGCTG
TATCTGCAAATGAACAGCCTGCGTGCCGAGGATACCGCGGTATATTACTGTGCGAGAGATCCTTATAGTTTTGACTACT
GGGGTCAGGGAACCCTGGTCACCGTCTCGAGC (SEQ ID NO: 1101)

BMS3h-198-2
GAGGTGCAGCCGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGATCTCAGCTATTAGCGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGATCCTTATAGTTTTGACTACT
GGGGTCAGGGAACCCTGGTCACCGTCTCGAGC (SEQ ID NO: 1102)

BMS3h-198-3
GAGGTGCAGCTGTTGGAGTCTGGGGGAGGCTCGGTACAGCCTGGGGGGTCCCTGCGTCTCTCCTGTGCAGCCACCGGAT
CCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGATCCTTACAGTTATGACTACT
GGGGTCAGGGAACCCTGGTCTCCGTCTCGAGC (SEQ ID NO: 1103)

TABLE 4-continued

Human Anti-CD40 Variable Domain Encoding Nucleotide Sequences

BMS3h-198-4
GAGGTGCAGCTGTTGGAGTCTGGGGGAGGCTTGGTACAGCCTGGGGGGTCCCTGCGTCTCTCCTGTGCAGCCTCCGGAC
TCACCTTTGCTGGGTATGAGATGTGGTGGGTCCGCCAGGCACCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCAGTATATCACTGTGCGAGAGATCCTTATAGTTTTGACTACT
GGGGTCAGGGAACCCTGGTCACCGTCTCGAGC (SEQ ID NO: 1104)

BMS3h-198-5
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCTGTGAAGGGCCGGTTCACCATCTCCCGCGACGATTCCAAGAACACGCTG
TATCTGCAAATGAACAGCCTGCGTGCCGAGGATACCGCAGTATATCACTGTGCGAAAGAACCTTATAGTTATGACTACT
GGGGTCAGGGAACCCTGGTCACCGTCTCGAGC (SEQ ID NO: 1105)

BMS3h-198-6
GAGGTGCAGCTGTTGGAGTCTGGGGGAGGCTTGGTACAGCCTGGGGGGTCCCTGCGTCTCTCCTGTGCAGCCTCCGGAT
CCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTCCCGAGGATACCGCGGTATATTACTGTGTGAAAGATCCTTATAGTTTTGACTACT
GGGGTCAGGGAACCCTGGTCACCGTCTCGAGC (SEQ ID NO: 1106)

BMS3h-198-7
GAGGTGCAGCTGTTGGAGTCTGGGGGAGGCTTGGTACAGCCTGGGGGGTCCCTGCGTCTCTCCTGTGCAGCCTCCGGAT
CCACCATTGCCGGGTATGAGATGTGGTGGGTCCGCCAGGCTCCGGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGTATATTACTGTGCGAGAGATCCTTATAGTTTTGACTACT
GGGGTCAGGGAACCCCGGTCACCGTCTCGAGC (SEQ ID NO: 1107)

BMS3h-198-8
GAGGTGCAGCTGATGGAGTCTGGGGGAGGCTTGGTACAGCCTGGGGGGTCCCTGCGTCTCTCCTGTGCAGCCTCCGGAT
CCACCTTTGCTGGGTATGAGATGTGGTGGTACCGCCAGGCTCCAGGGAAGGGTCTAGAGCGGGTCTCAGCTATTAGTGG
AAGTGGTAGAAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGATCCTTATAGTTTTGACTACT
GGGGTCAGGGAACCCTGGTCACCGTCTCGAGC (SEQ ID NO: 1108)

BMS3h-198-9
GAGGTGCAGCTGCTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAGCACGTACTACGCAGACTCCGTGAAGGGCCGGTTCACCATCTCCCGCGACGATTCCAAGAACACGCTG
TATCTGCAAATGAACAGCCTGCGTGCCGAGGATACCGCAGTATATTACTGTGCGAAAGAACCTTATAGTTTTGACTACT
GGGGTCAGGGAACCCTGGTCACCGTCTCGAGC (SEQ ID NO: 1109)

BMS3h-198-10
GAGGTGCAGCTGTTGGAGTCTGGGGGAGGCTTGGTACAGCCTGGGGGGTCCCTGCGTCTCTCCTGTGCAGCCTCCGGAT
CCACCATTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGATCCATATAGTTTTGACTACT
GGGGTCAGGGAACCCTGGTCACCGTCTCGAGC (SEQ ID NO: 1110)

BMS3h-198-11
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGACCCTTATAGTTTTGACTACT
GGGGTCAGGGAACCCTGGTCTCCGTCTCGAGC (SEQ ID NO: 1111)

BMS3h-198-12
GAGGTGCAGCTGTTGGAGTCTGGGGGAGGCTTGGTACAGCCTGGGGGGTCCCTGCGTCTCTCCTGTGCAGCCTCCGGAT
TCACCATTGCTGGGTATGAGATGTGGTGGGTCCGCCAGGCTCCAGGGAAGGGTCTAGAGCGGGTCTCCGCTATTAGTGG
TAGTGGTGGTAGCACATACTACGCGGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGATCCTTATAGTTTTGACTACT
GGGGTCAGGGAACCCTGGTCACCGTTTCGAGC (SEQ ID NO: 1112)

BMS3h-198-13
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGTGTCTCAGCTATTAGTGG
TAGTGGTGGTAGCACATACTACGCAGACTCCGTGAAGGGCCGGTTCACCATCACCCGCGACGATTCCAAGAACACGCTG
TATCTGCAAATGAACAGCCTGCGTGCCGAGGATACCGCGGTATATTACTGTGCGAAAGAGCCTTATAGTTTTGACTACT
GGGGTCAGGGAACCCTGGTCACCGTCTCGAGC (SEQ ID NO: 1113)

BMS3h-198-14
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGTTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATACCAAGAACACGCTG
TATCTGCAAATGAACAGCCTGCGTGCCGAGGATACCGCGGTATATTACTGTGCGAAAGATCCTTATAGTTTTGACTACT
GGCGTCAGGGAACCCTGGTCACCGTCTCGAGC (SEQ ID NO: 1114)

TABLE 4-continued

Human Anti-CD40 Variable Domain Encoding Nucleotide Sequences

BMS3h-198-15
GAGGTGCAGCTGTTGGAGTCTGGGGGAGGCTTGGTACAGCCTGGGGGGTCCCTGCGTCTCTCCTGTGCAGCCTCCGGAT
CCACCTTTGCTGGGTATGAGGTGTGGTGGGTCCGCCAGGCTCCAGGGAAGGGTCTGGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGATCCTTATAGTTTTGACTACT
GGGGTCAGGGAACCCTGGTCACCGTCTCGAGC (SEQ ID NO: 1115)

BMS3h-198-16
GAGGTGCAGCTGTTGGAGTCTGGGGGAGGCTTGGTACAGCCTGGGGGGTCCCTGCGTCTCTCCTGTGCAGCCTCCGGAT
CCACCTTTGCTGGGTATGAGATGTGGTGGGTCCGCCAGGCTCCAGGGAAGGGTCTAGAGCGGATCTCAGCTATTAGTGG
TAGTGGTGGTAGCACATACTACGCAGACTCCGTGAAGGGCCGGTTCACCATCTCCCGCGACGATTCCAAGAACACGCTG
TATCTGAAAATGAACAGCCTGCGTGCCGAGGATACCGCGGTATATTACTGTGCGAAAGATCCTTATAGTTTTGACTACT
GGGGTCAGGGAACCCTGGTCACCGTCTCGAGC (SEQ ID NO: 1116)

BMS3h-198-17
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGATCCTTATAGTTTTGACTACT
GGGGTCAGGGAACCCTGGTCACCGTCTCGAGC (SEQ ID NO: 1117)

BMS3h-198-18
GAGGTGCAGCTGTTGGAGTCTGGGGGAGGCTTGGTACAGCCTGGGGGGTCCCTGCGTCTCTCCTGTGCAGCCTCCGGAC
TCACCTTTGCTGGGTATGAGATGTGGTGGGTCCGCCGGGCTCCAGGGAAGGGTCTAGAGCGGGTCGCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGATCCTTATAGTTTTGACTACT
GGGGTCAGGGAACCCTGGTCACCGTCTCGAGC (SEQ ID NO: 1118)

BMS3h-198-19
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGTTGTGGTGGGTCCGCCAGGCCCCAGGGAAGGGTCTAGAGCGGGTCTCAGCTATTAGTGG
AAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGATCCTTATAGTTTTGACTACC
GGGGTCAGGGAACCCTGGTCACCGTCTCGAGC (SEQ ID NO: 1119)

BMS3h-198-20
GAGGTGCAGCTGTTGGAGTCTGGGGGAGGCTTGGTACAGCCTGGGGGGTCCCTGCGTCTCTCCTGTGCAGCCCCCGGAT
TCACCTTAGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGAACCTTATAGTTTTGACTACT
GGGGTCAGGGAACCCTGGTCACCGTCTCGAGC (SEQ ID NO: 1120)

BMS3h-198-21
GAGGTGCAGCTGTTGGAGTCTGGGGGAGGCTTGGTACAGCCTGGGGGGTCCCTGCGTCTCTCCTGTGCAGCCTCCGGAC
TCACCTTTGCTGGGTATGAGATGTGGTGGGTCCGTCGGGCTCCAGGGAAGGGTCTAGAGCGGGTCTCAGCTATTAGTGG
TAGTGGTGGTAGCACATACTACGCAGACTCCGTGAAGGGCCGGTTCACCACCTCCCGCGACGATTCCAAGAACACGCTG
TATCTGCAAATGAACAGCCTGCGTGCCGAGGATACCGCGGTATATTACTGTGCGAGAGATCCTTATAGTTTTGACTACT
GGGGTCGGGGAACCCTGGTCACCGTCTCGAGC (SEQ ID NO: 1121)

BMS3h-198-22
GAGGTGCAGCTGTTGGAGTCTGGGGGAGGCTTGGTACAGCCCGGGGGGTCCCTGCGTCTCTCCTGTGCCGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGCGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGAACCTTATAGTTATGACTACT
GGGGTCATGGAACCCTGGTTACTGTCTCGAGC (SEQ ID NO: 1122)

BMS3h-198-23
GAGGTGCAGCCGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAACACATACTACGCAGACTCCGTGAAGGGCCGGTTCACCATCTCCCGCGACGATTCCAAGAACACGCTG
TATCTGCAAATGAACAGCCTGCGTGCCGAGGATACCGGGGTATATTACTGTGCGAGAGATCCTTATAGTTTTGACTACT
GGGGTCAGGGTACCCTGGTCACCGTCTCGAGC (SEQ ID NO: 1123)

BMS3h-198-24
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGAACCTTATAGTTTTGACTCCT
GGGGTCAGGGAACCCTGGTCACCGTCTCGAGC (SEQ ID NO: 1124)

BMS3h-198-25
GAGGCGCAGCTGTTGGAGTCTGGGGGAGGCTTGGTACAGCCTGGGGGGTCCCTGCGTCTCTCCTGTGCAGCCTCCGGAT
TAACCTTCGCTGGGTATGAGATGTGGTGGGTCCGCCAGGCTCCAGGGAAGGGTCTAGAGCGCGTCTCAGCTATTAGTGG
TAGTGGCGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGATCCTTATAGTTTTGACTACT
GGGGTCAGGGAACCCTGGTCACCGTCTCGAGC (SEQ ID NO: 1125)

TABLE 4-continued

Human Anti-CD40 Variable Domain Encoding Nucleotide Sequences

BMS3h-198-26
GAGGTGCAGCTGTTGGAGTCTGGGGGAGGCTTGGTACAGCCTGGGGGGTCCCTGCGTCTCTCCTGTGCAGCCTCCGGAT
CCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCTCCATCTCCCGCGACGATTCCAAGAACACGCTG
TATCTGCAAATGAACAGCCTGCGTGCCGAGGATACCGCGGTATATTACTGTGCGAAAGAACCTTATAGTTTTGACCACT
GGGGTCAGGGAACCCTGGTCACCGTCTCGAGC (SEQ ID NO: 1126)

BMS3h-198-27
GAGGTGCAGCTGTTGGAGTCTGGGGGAGGCTTGGTACAGCCTGGGGGTCCCTGCGTCTCTCCTGTGCAGCCTCGGAT
CCACCTTTGCTGGGTATGAGATGTGGTGGGTCCGCAGGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGATCCTTATAGTTTTGACTACT
GGGGTCAGGGAACCCTGGTCACCGTCTCGAGC (SEQ ID NO: 1127)

BMS3h-198-28
GAGGTGCAGCTGTTGGAGTCTGGGGGAGGCTTGGTACAGCCTGGGGGTCCCTGCGTCTCTCCTGTGCAGCCTCCGGAT
TCACCTTTGCTGGGTATGAGATGTGGTGGTTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGATCCTTATAGTTTTGACAACT
GGGGTCAGGGAACCCTGGTCACCGTCTCGAGC (SEQ ID NO: 1128)

BMS3h-198-29
GAGGTGCAGCTGTTGGAGTCTGGGGGAGGCTTGGTAGAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGAACCTTATAGTTTTGACCACC
GGGGTCAGGGAACCCTGGTCACCGTCTCGAGC (SEQ ID NO: 1129)

BMS3h-198-30
GAGGTGCAGCTGTTGGAGTCTGGGGGAGGCTTGGTACAGCCTGGGGGTCCCTGCGTCTCTCCTGTGCAGCCTCCGGAT
ACACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGAACCTTATAGTTTTGACCACC
GGGGTCAGGGAACCCTGGTCACCGTCTCGAGC (SEQ ID NO: 1130)

BMS3h-198-31
GAGGTGCAGCTGTTGGAGTCTGGGGGAGGCTTGGTACAGCCTGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCTGTGAAGGGCCGGTTCACCATCTCCCGCGACAATTCCAAGAACACGCTG
TATCTGCAAATGAACAGCCTGCGTGCCGAGGATACCGCGGTATATCACTGTGCGAAAGAACCTTATAGTTATGACTACT
GGGGTCAGGGAACCCTGGTCACCGTCTCGAGC (SEQ ID NO: 1131)

BMS3h-198-32
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGTTCCGCCAGGCTCCAGGGAAGGGTCTAGAGCGGGTCTCAGCTATTAGTGG
TAGTGGTGGTAGCACATACTACGCAGACTCCGTGAAGGGCCGGTTCACCATCTCCCGCGACAATTCCAAGAACACGCTG
TATCTGCAAATGAACAGCCTGCGTGCCGAGGATACCGCGGTATATTACTGTGCGAAAGATCCTTATAGTTTTGACAACT
GGGGTCAGGGAACCCTGGTCACCGTCTCGAGC (SEQ ID NO: 1132)

BMS3h-198-33
GAGGTGCAGCTGTTGGAGTCTGGGGGAGGCTTGGTACAGCCTGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGCGGGTCTCAGCTATTAGTGG
TAGTGGTGGTAGCACATACTACGCAGACTCTGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGAACCTTATAGTTATGACTACT
GGGGTCAGGGAACCCTGGTCACCGTCTCGAGC (SEQ ID NO: 1133)

BMS3h-198-34
GAGGTGCAGCTGTTGGAGTCTGGGGGAGGCTTGGTACAGCCTGGGGGTCCCTGCGTCTCTCCTGTGCAGCCTCCGGAT
TCACCTTTGCTGGGTATGAGATGTGGTGGGTCCGCCAGGCTCCCGGGAAGGGTCTAGAGCGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGATCCTTATAGTTTTGACAACT
GGGGTCAGGGAACCCTGGTCACCGTCTCGAGC (SEQ ID NO: 1134)

BMS3h-198-35
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGATGTGGTGGGTCCGCCAGGCTCCAGGGAAGGGTCTAGAGTGGGTCTCAGCTATTAGTGG
TAGTGGTGGTAGCACATACTACGCAGACTCTGTGAAGGGCCGGTTCACCATCTCCCGCGACGATTCCAAGAACACGCTG
TATCTGCAAATGAACAGCCTGCGTGCCGAGGATACCGCGGTATATCACTGTGCGAAAGAACCTTATAGTTATGACTACT
GGGGTCAGGGAACCCTGGTCACCGTCTCGAGC (SEQ ID NO: 1135)

BMS3h-198-36
GAGGTGCAGCTGTTGGAGTCTGGGGGAGGCTTGGTACAGCCTGGGGGTCCCTGCGTCTCTCCTGTGCAGCCTCCGGAT
TCACCTTTGCTGGGTATGAGATGTGGTGGTTCCGCCAGGCTCCAGGGAAGGGTCTAGAGTGGGTCTCAGCTATTAGTGG
TAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGATCCTTATAGTTTTGACAACT
GGGGTCAGGGAACCCTGGTCACCGTCTCGAGC (SEQ ID NO: 1136)

TABLE 4-continued

Human Anti-CD40 Variable Domain Encoding Nucleotide Sequences

BMS3h-198-37
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGTTGTGGTGGGTCCGCCAGGCCCCAGGGAAGGGTCTAGAGCGGGTCTCAGCTATTAGTGG
AAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAAAGATCCTTATAGTTTTGACTACC
GGGGTCAGGGAACCCTGGTCACCGTCTCGAGC (SEQ ID NO: 1137)

BMS3h-198-38
GAGGTGCAGCTGTTGGAGTCTGGGGGAGGCTTGGTACAGCCTGGGGGGTCCCTGCGTCTCTCCTGTGCAGCCTCCGGAT
TCACCTTTGCTGGGTATGAGTTGTGGTGGGTCCGCCAGGCCCCAGGGAAGGGTCTAGAGCGGGTCTCAGCTATTAGTGG
AAGTGGTGGTAGCACATACTACGCAGACTCCGTGAAGGGCCGGTTCACCATCTCCCGCGACGATTCCAAGAACACGCTG
TATCTGCAAATGAACAGCCTGCGTGCCGAGGATACCGCGGTATATTACTGTGCGAGAGATCCTTATAGTTTTGACTACT
GGGGTCAGGGAACCCTGGTCACCGTCTCGAGC (SEQ ID NO: 1138)

BMS3h-202-1
GAGGTGCAGCTGTTGGAGTCTGGGGGGGGCTTGGTACAGCCTGGGGGGTCCCTGCGTCTCTCCTGTGCAGCCTCCGGAT
TCACCTTTCCGACTGCTGAGATGCTGTGGGTCCGCAAGGCTCCAGGGAAGGGTCTAGAGTGGGTCTCATCTATTTCGGC
TAGTGGTGGTTCTACATACTACGCAGACTCCGTGAAGGGCCGGTTCACCATCTCCCGCGACAATTCCAAGACACACGCTG
TATCTGCAAATGAACAGCCTGCGTGCCGAGGACACCGCGGTATATTACTGTGCGAAAGAGCCGGTGAGTTATGTGGCGA
CGTTTGACTACTGGGGTCAGGGAACCCTGGTCACCGTCTCGAGC (SEQ ID NO: 1139)

BMS3h-202-2
GAGGTGCAGCTGTTGGTGTCTGGGGGAGGCTTGGTACAGCCTGGGGGGTCCCTGCGTCTCTCCTGTGCAGCCTCCGGAT
TCACCTTTCCGACTGCTGAGATGTTGTGGGTCCGCCAGGCTCCAGGGAAGGGTCCAGAGTGGGTCTCATCAATTTCGGC
TAGTGGTGGTTCTACATACTATGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGGTGAGTTATGTGGCGA
CGTTTGACTACTGGGGTCAGGGAACCCTGGTCACCGTCTCGAGC (SEQ ID NO: 1140)

BMS3h-202-3
GAGGTGCAGCTGTTGGAGTCTGGGGGAGGCTTGGTACAGCCTGGGGGGTCCCTGCGTCTCTCGTGTGCAGCCTCCGGAT
TCACCTTTCCGACTGCCGAGATGGTGTGGGTCCGCAAGGCTCCAGGGATGGGTCTAGAGTGGGTCTCATCTATTTCGGC
TAGTGGTGGTTATACATACTACGCAGACTCCGTGAAGGGCCGGTTCACCATCTCCCGCGACAATTCCAAGAACATGCTG
TATCTGCAAATGAACAGCCTGCGTGCCGAGGACACCGCGGTATATTACTGTGCGAAAGAGCCGGTGAGTTATGTGGCGA
CGTTTGACTACTGGGGTCAGGGAGCCCTGGTCACCGTCACGAGC (SEQ ID NO: 1141)

BMS3h-202-4
GAGGTGCAGCTGTTGGTGTCTGGGGGAGGCTTGGTACAGCCTGGGGGGTCCCTGCGTCTCTCCTGTGCAGCCTCCGGAT
TCACCTTTCCGACTGCTGAGATGGTGTGGGTCCGCCAGGCTCCAGGGAAGGGTCTAGAGTGGGTCTCATCTATTTCGGC
TAGTGGTGGTTCTACATACTACGCAGACTCCGTGAAGGGCCGGTTCTCCATCTCCCGCGACGATTCCAAGAACACGCTG
TATCTGCAAATGAACAGCCTGCGTGCCGAGGACACCGCGGTATATTACTGTGCGAAAGAGCCGGTGAGTTATGTGGCGA
CGTTTGACTACTGGGGTCATGGAGCCCTGGTCACCGTCTCGAGC (SEQ ID NO: 1142)

BMS3h-202-5
GAGGTGCAGCTGTTGGAGTCTGGGGGAGGCTTGGTACAGCCTGGGGGGTCCCTGCGTCTCTCCTGTGCAGCCTCCGGAT
TCACATTTCCGACTGCTGAGATGTTGTGGGTCCGCCAGGCTCCAGGGAAGGGTCTAGAGTGGGTCTCATCTATTTCGGC
TAGTGGTGGTTCTACATACTACGCAGACTCCGTGAAGGGCCGGTTCACCATCTCCCGCGACAATTCCAAGAACACGCTG
TATCTGCAAATGAACAGCCTGCGAGCCGAGGACACCGCGGTATATTACTGTGCGAAAGAGCCGGTGAGTTATGTGGCAA
CGTTTGACTACTGGGGTCAGGGAACCCTGGTCACCGTCTCGAGC (SEQ ID NO: 1143)

BMS3h-202-6
GAGGCGCAGCTGTTGGAGTCTGGGGGTGGCTTGGTACAGCCTGGGGGGTCCCTGCGTCTCTCCTGTGCAGCCTCCGGAT
TCACCTTTCCGACTGCTGAGATGGTGTGGGTCCGCCAGGCTCCAGGGAAGGGTCTAGAGTGGATCTCATCTATTTCGGC
TAGTGGTGGTTCTACATACTACGCAGACTCCGTGAAGGGCCGGTTCACCATCTCCCGCGACAATTCCAAGAACACGCTG
TATCTGCAATTGAACAGCCTGCGTGCCGAGGACACCGCGGTATATTACTGTGCGAAAGAGCCGGTGAGTTATGTGGCGA
CGTTTGACTACTGGGGTCGGGGAACCCTGGTCACCGTCTCGAGC (SEQ ID NO: 1144)

BMS3h-202-7
GAGGTGCAGCTGTTGGAGTCTGGGGGAGGCTTGGTACAGCCTGGGGGGTCCCTGCGTCTCTCCTGTGCAGCCTCCGGAT
TCACATTTCCGACTGCTGAGATGTTGTGGGTCCGCCAGGCTCCAGGGAAGGGTCTAGAGTGGGTCTCATCTATTTCGGC
TAGTGGTGGTTCTACATACTACGCAGACTCCGTGAAGGGCCGGTTCACCATCTCCCGCGACAATTCCAAGAGCACGCTG
TATCTGCAAATGAACAGCCTGCGTGCCGAGGACACCGCGGTATATTACTGTGCGAAAGAGCCGGTGAGTTATGTGGCGA
CGTTTGACTACTGGGGTCCAGGAGCCCTGGTCACCGTCTCGAGC (SEQ ID NO: 1145)

BMS3h-202-8
GAGGTGCAGCTGTTGGAGTCCGGGGGAGGCTTGGTACAGCCTGGGGGGTCCCTGCGTCTCTCCTGTGCAGCCTCCGGAT
TCACCTTTCCGACTGCTGAGATGCTGTGGGTCCGCAAGGCTCCAGGGAAGGGTCTAGAGTGGGTCTCATCTATTTCGGC
TAGTGGTGGTTCTACATACTACGCAGACTCCGTGAAGGGCCGGTTCACCATCTCCCGCGACAATTCCAAGAACACGCTG
TTTCTGCAAATGAACAGCCTGCGTGCCGAGGACACCGCGGTATATTACTGTGCCAAAGAGCCGGTGAGTTATGTGGCGA
CGTTTGACTACTGGGGTCAGGGAACCCTGGTCACCGTCTCGAGC (SEQ ID NO: 1146)

BMS3h-202-9
GAGGTGCAGCTGTTGGAGTCTGGGGGAGGCTTGGTACAGCCTGGGGGGTCCCTGCGTCTCTCCTGTGCAGCCTCCGGAT
TCACATTTCCGACTGCTGAGATGTTGTGGGTCCGCCAGGCTCCAGGGAAGGGTCTAGAGTGGGTCTCATCTATTTCGGC
TAGTGGTGGTTCTACATACTACGCAGACTCCGTGAAGGGCCGGTTCACCATCTCCCGCGACAATTCCAAGAACACGCTG
TATCTGCAAATGAACAGCCTGCGTGCCGAGGACACCGCGGTATATTACTGTGCGAAAGAGCCGGTGAGTTATGTGGCGA
CGTTTGACTACTGGGGTCCAGGAGCCCTGGTCACCGTCTCGAGC (SEQ ID NO: 1147)

TABLE 4-continued

Human Anti-CD40 Variable Domain Encoding Nucleotide Sequences

BMS3h-202-10
GAGGTGCAGCTGTTGGAGTCTGGGGGAGGCTTGGTACAGCCTGGGGGGTCCCTGCGTCTCTCCTGTGCAGCCTCCGGAT
TCACCTTTCCGACTGCTGAGATGCTGTGGGTCCGCCAGGCTCCAGGGAAGGGTCTAGAGTGGGTCTCATCTATTTCGGC
TAGTGGTGGTTCTACATACTACGCAGACTCCGTGAAGGGCCGGTTCACCATCTCCCGCGACAATTCCAAGAACACGCTG
TATTTGCAAATGAACAGCCTGCGTGCCGAGGACACCGCGGTATATTACTGTGCGAAAGAGCCGGTGTATTATGTGGCGA
CGTTTGACTACTGGGGTCAGGGAACCCTGGTCACCGTCTCGAGC (SEQ ID NO: 1148)

BMS3h-202-11
GAGGTGCAGCTGTTGGAGTCCGGGGGAGGCTTGGTACAGCCTGGGGGGTCCCTGCGTCTCTCCTGTGCAGCCTCCGGAT
TCACCTTTCCGACTGCTGAGATGCTGTGGGTCCGCAAGGCTCCAGGGAAGGGTCTAGAGTGGGTCTCATCTATTTCGGC
TAGTGGTGGTTCTACATACTACGCAGACTCCGTGAAGGGCCGGTTCACCATCTCCCGCGACAATTCCAAGAACACGCTG
TATCTGCAAATGAACAGCCTGCGTGCCGAGGACGCCGCGGTATATTACTGTGCGAAAGAGCCGGTGAGTTATGTGGCGA
CGTTTGACTACTGGGGTCAGGGAACCCTGGTCACCGTCTCGAGC (SEQ ID NO: 1149)

BMS3h-217-1
AACATCCAGATGACCCAGTCTCCATCCTCCCTGTCTGCATCTGTAGGAGACCGTGTCACCATCACTTGCCGGGCAAGTC
ATTTTATTGGTACTCTGTTAACTTGGTACCAGCATAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1150)

BMS3h-217-2
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCAGAAACCACGGAAAGCCCCTAAACTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAT
CCTGAAGATTTTGCTACGTACTACTGTGGTCAGGGGGTGCTGTGGCCTCCGACGTTCGGTCAAGGGACCAAGGTGGAAA
TCAAACGG (SEQ ID NO: 1151)

BMS3h-217-3
GACATCCAGATGACCCAGTCTCCGTCCTCCCTGACTGCATCTGTAGGAGACCGTGTCACCATCACTTGCCGGGCAAGTC
ATTTTATTGGTACTCTGTTATCTTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAATCTGCAA
CCTGAAGATTTTGCTACGTACTACTGTGGTCAGGGGGTGCTGTGGCCTCCTACGTTCGGCCAAGGGACCAAGGTGGAAA
ACATACGG (SEQ ID NO: 1152)

BMS3h-217-4
GACATCCAGATGACCCAGTCTCCATCCTCCCTGTCTGCATCTGTAGGAGACCGTGTCACCATCACTTGCCGGGCAAGTC
ATTTTATTGCTACTCTGTTATCTTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTCCGACGTTCGGCCAAGGGACCAAGGTGGAAA
TCAAACGG (SEQ ID NO: 1153)

BMS3h-217-5
GACATCCAGATGACCCAGTCTCCATCCTTCCTGTCTGCATCTGTAGGAGACCGTGTCACCATCACTTGCCGGGCAAGTC
ATTTTATTGCTACTCTGTTATCTTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTCCGACGTTCGGCCAAGGGACCAAGGTGGAAA
TCAAACGG (SEQ ID NO: 1154)

BMS3h-217-6
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCAGAAACCAGGGAAAGCCACTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGACTTTGCTACGTACTACTGTGGTCAGGGGGTGCTGTGGCCCCCGACGTTCGGCCAGGGGACCAAGGTGGAAA
TCAAACGT (SEQ ID NO: 1155)

BMS3h-217-7
GACATCCAGATGACCCAGTCTCCATCCTCCCTGTCTGCATCTGTAGGAGACCGTGTCACCATCACTTGCCGGGCAAGTC
ATTTTATTGGTTCTCTGTTATCTTGGTACCAGCATAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1156)

BMS3h-217-8
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCATAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1157)

BMS3h-217-9
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCATAAACCAGGGAAAGCCCCTAAGCTCCTGATCACTTATGGTTCCAT
GTTGCAAAGTGGGGTCCCATCACGTTTCAGTGGCAGTGGATCTGGGACAGATTTCACTCTCACCATCAGCAGTCTGCAA
CCTGAAGATTTTGCAACGTACTACTGTGGTCAGGGGGTGCTGTGGCCTGCGACGTTCGGCCAAGGGACCAAGGTGGAAA
TCAAACGG (SEQ ID NO: 1158)

TABLE 4-continued

Human Anti-CD40 Variable Domain Encoding Nucleotide Sequences

BMS3h-217-10
GACATCCAGATGACTCAGTCTCCATCCTCCCTGTCTGCATCTGTAGGAGACCGAGTCACCATCACTTGCCGGGCAAGTC
ATTTTATTGGTACTCTGTTATCCTGGTACCAGCATAAACCAGGGAAAGCCCCTAAGCTCCTGATCACCTATGGTTCCTT
GTTGCAAAGTGGGGTCCCATCACGTTTCAGTGGCAGTGGATCTGGGACAGAATTCACTCTCACCATCAGCAGTCTGCAA
CCTGAAGATTTTGCTACGTACTACTGTGGTCAGGGAGTGCTGTGGCCTGCGACGTTCGGCCAAGGGACCAAGGTGGAAA
TCAAACGG (SEQ ID NO: 1159)

BMS3h-217-11
GACATCCAGATGACCCAGTCTCCATCCTCCCTGACTGCATCTGTAGGAGACCGTGTCACCATCACTTGCCGGGCAAGTC
ATTTTATTGGTACTCTGTTATCTTGGTACCAGCATAAACCAGGGAAAGCCCCTAAGCTCCTGATCACTTATGGTTCCTT
GTTGCAAAGTGGGGTCCCATCACGTTTCAGTGGCAGTGGATCTGGGACAGAATTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1160)

BMS3h-217-12
AACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCATAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1161)

BMS3h-217-13
GACATCCAGATGACCCAGTCTCCATCCTCCCTGTCTGCATCTGTAGGAGACCGTGTCACCATCAATTGCCGGGCAAGTC
ATTTTATTGGTACTCTGTTATCTTGGTACCAGCATAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1162)

BMS3h-217-14
GACATCCAGTTGACCCAGTCACCATCCTCCCTGTCTGCATCTGTAGGAGACCGTGTCACCATCACTTGCCGGGCAAGTC
ATTTTATTGGTACTCTGTTATCTTGGTACCAGCAGAAACCAGGGAAAGCCACTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTCCGACGTTCGGCCAAGGGACCAAGGTGGAAA
TCAAACGG (SEQ ID NO: 1163)

BMS3h-217-15
GACATCCAGATGACACAGTCTCCATCCTCCCTGTATGCATCTGTAGGAGACCGTGTCACCATCACTTGCCGGGTAAGTC
ATTTTATTGGTACTCTGTTATCTTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCAGCATCAGCAGTCTGCAA
CCTGAAGATTTTGCTACGTACTACTGTGGTCAGGGGGTGCTGTGGCCCCCGACGTTCGGACAAGGGACCAAGGTGGAAA
TCAAACAG (SEQ ID NO: 1164)

BMS3h-217-16
GACATTCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCAGAAACCAAGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTCCGACGTTCGGCCAAGGGACCAAGGTGGAAA
TCAAACGG (SEQ ID NO: 1165)

BMS3h-217-17
GACATCCAGATTATCCAGTCTCCATCCTCCCTTTCTGCATCTGTAGGAGACCGTGTCACCATCACTTGCCGGGCAAGTC
ATTTTATTGGTACTCTGTTATCTTGGTACCAGCAGAAACAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTCCGACGTTCGGCCAAGGGACCAAGGTGGAAA
TCAAACGG (SEQ ID NO: 1166)

BMS3h-217-18
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1167)

BMS3h-217-19
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCTGAAACCAGGGAAAGCCCCAAAGCTCCTGATCACTTATGGTTCCTG
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTAGAAA
ACAAACGG (SEQ ID NO: 1168)

BMS3h-217-20
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCTTAAACCAGGGAAAGCCCCTAAGCTCCTGATCACTTATGGTTCCTT
GTTGCAACGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1169)

TABLE 4-continued

Human Anti-CD40 Variable Domain Encoding Nucleotide Sequences

BMS3h-217-21
GACATCCAGATGACCCAGGCTCCATCCTCCCTGTCTGCATCTGTAGGAGACCGTGTCACCATCACTTGCCGGGCAAGTC
ATTTTATTGGTACTCTGTTATCTTGGTACCAGCTGAAACCAGGGAAAGCCCCTAAGCTCCTGATCACTTATGGTTCCTT
GTTGCAGAGTGGGGTCCCATCACGTTTCAGTGGTAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTTGAAA
ACAAACGG (SEQ ID NO: 1170)

BMS3h-217-22
GACATCCAGATGACCCAGTCTCCATCCTCCCTGTCTGCATCTGTAGGAGACCGTGTCACCATCACTTGCCGGGCAAGTC
ATTTTATTGGTTCTCTGTTATCTTGGTACCAGCAGAAACCAGGGAAAGCCCCAAAGCTCCTGATCACTTATGGTTCCTT
GTTGCAAAGTGGGGTCCCATCACGTTTCAGTGGCAGTGGATCTGGGACAGATTCGCTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1171)

BMS3h-217-23
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1172)

BMS3h-217-24
GACATCCTGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1173)

BMS3h-217-25
GACATCCAGATGACCCAGTCTCCATCCTCCCTGTCTGCATCTGTAGGAGACCGTGTCACCATCACTTGCCGGGCAAGTC
ATTTTATTGGTACTCTGGTATCTTGGTACCAGCAGAAACCGGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTACGGCCAAGGGACCAAGGTGGAAA
TCAAACGG (SEQ ID NO: 1174)

BMS3h-217-26
GACATCCAGATGACCCAGTCTCCATCCTCTCTGTCTGCATCTGTAGGAGACCGTGTCACCATCACTTGCCGGGCAAGTC
ATTTTATTGGTACTCTGGTATCTTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACTTTCGGCCAAGGGACCAAGGTGGAAA
ACAAACGG (SEQ ID NO: 1175)

BMS3h-217-27
GACATCAAGATGACCCAGTCTCCATCCTCCCTGTCTGCATCTGTAGGAGACCGTGTCACCATCACTTGCCGGGCGAGTC
ATTTTATTGGTACTCTGGTATCTTGGTACCAGCAGAAACCAGGGAAAGCCCCAAAGCTCCTGATCACTTATGGTTCCAT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1176)

BMS3h-217-28
GACATCCAGATGACCCAGTCTCCATCCTCCCTGTCTGCATCTGTAGGAGACCGTGTCACCATCACTTGCCAGGCAAGTC
ATTTTATTGGTACTCTGGTATCCTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCCGCGACGTTCGGCCAAGGGACCAAGGTGGAAA
TCAAACGG (SEQ ID NO: 1177)

BMS3h-217-29
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCAGAAACCAGGGAAAGCCCCTAAGCTCCTGATCACTTATGGTTCCTG
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1178)

BMS3h-217-30
GACATCCAGATGACCCAGTCTCCATCCTCCCTGTCTGCATCTGTTGGAGACCGTGTCACCATCACTTGCCGGGCAAGTC
ATTTTATTGGTACTCTGTTATCTTGGTACCAGCTGAAACCAGGGAAAGCCCCTAAGCTCCTGATCACTTATGGTTCCTG
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1179)

BMS3h-217-31
GACATCCAGATGACCCAGTCTCCATCCTCCCTGTCTGCATCTGTAGGAGACCGTGTCACCATCACTTGCCGGGCAAGTC
ATTTTATTGGTACTCTGTTATCTTGGTACCAGCAGAAACCGGGGAAAGCCCCTAAGCTCCTGATCACTTATGGTTCCTT
GTTGCAAAGTGGGGTCCCATCACGTTTCAGTGGCAGTGGATTTGGGACAGATTTCACTCTCACCATCAGCAGTCTGCAA
CCTGAAGATTTTGCTACGTACTACTGTGGTCAGGAGGTGCTGTGGCCTGCGACGTTCGGCCAAGGGACTAAGGTGGAAA
TCAAACGG (SEQ ID NO: 1180)

TABLE 4-continued

Human Anti-CD40 Variable Domain Encoding Nucleotide Sequences

BMS3h-217-32
GACATCCAGATGACCCAGTCTCCATCCTCCCTGTCTGCATCTGTAGGAGACCGTGTCTCCATCACTTGCCGAGCAAGTC
ATTTTATTGGTACTCTGTTATCTTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATTTGGGACAGATTTCACTCTCACCATCAGCAGTCTGCAA
CCTGAAGATCTTGCTACGTACTACTGTGGTCAGGAGGTGCTGTGGCCTGCGACGTTCGGCCAAGGGACCAAGGTGGAAA
TCAAACGG (SEQ ID NO: 1181)

BMS3h-217-33
GACATCCAGATGACCCAGTCTCCATCCTCCCTGTCTGCATCTGTAGGAGACCGTGTCACCATCACTTGCCAGGCAAGTC
ATTTTATTGGTACTCTGTTATCTTGGTACCAGCAGAAACCAGGGAAAGCCCCTAAGCTCCTGATCACTTATGGTTCCTT
GTTGCAAAGTGGGGTCCCATCACGTTTCAGTGGCAGTGGATTTGGGACAGATTTCACTCTCACCATCAGCAGTCTGCAA
CCCGAAGATTTTGCTACGTACTACTGTGGTCAGGAGGTGCTGTGGCCTGCGACGTTCGGCCAAGGGACCAAGGTGGAAA
TCAAACGG (SEQ ID NO: 1182)

BMS3h-217-34
GACATCCAGATGACCCAGTCTCCATCCTCCCTGTCTGCATCAGTAGGAGACCGTGTCACCATCACTTGCCGGGCAAGTC
ATTTTATTGGTACTCTGTTATCTTGGTACCAGCAGAAACCTGGGAAAGCCCCTAAGCTCCTGATCACTTATGGTTCCTT
GTTGCAAAGTGGGGTCCCATCACGTTTCAGTGGCAGTGGATTTGGGACAGAATTCACTCTCACCATCGGCAGTCTGCAA
CCTGAAGATTTTGCTACGTACTACTGTGGTCAGGGGGTGCTGTGGCCTGCGACGTTCGGCCAAGGGACCAAGGTGGAAA
TCAAACGG (SEQ ID NO: 1183)

BMS3h-217-35
GACATCCAGATGACCCAGTCACCATCCTCCCTGTCTGCATCTGTAGGAGACCGTGTCACCATCACTTGCCGGGCAAGTC
ATTTTATTGGTACTCTGTTATCTTGGTACCAGCAGAAACCAGGGAAAGCCACTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTCCGACGTTCGGCCAAGGGACCAAGGTGGAAA
TCAAACGG (SEQ ID NO: 1184)

BMS3h-217-2301
GACATCCAGATGACCCAGTCTCCATCCTCCCTGTCTGCATCTGTAGGAGACCGTGTCACCATCACTTGCCGGGCAAGTC
ACTTCATTGCCAGTCTGTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1185)

BMS3h-217-2302
GACATCCAGATGACCCAGTCTCCATCCTCCCTGTCTGCATCTGTAGGAGACCGTGTCACCATCACTTGCCGGGCAAGTC
ATTTCATTGCCCAGCTGTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1186)

BMS3h-217-2303
GACATCCAGATGACCCAGTCTCCATCCTCCCTGTCTGCATCTGTAGGAGACCGTGTCACCATCACTTGCCGGGCAAGTC
ATTTCATTGCCCAGCTGTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAGACGG (SEQ ID NO: 1187)

BMS3h-217-2304
GACATCCAGATGACCCAGTCTCCATCCTCCCTGTCTGCATCTGTAGGAGACCGTGTCACCATCACTTGCCGGGCAAGTC
ATTACATTGCCTCCCTGTTATCTTGGTACCAGGTGAAACCAGGGAAAGCCCCTAAGCTCCTGATCACTTATGGTTCCTT
GTTGCAGAGTGGGGCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1188)

BMS3h-217-2305
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTGGGCCTCCTA
CTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1189)

BMS3h-217-2306
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTGGACGTCCTA
CTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1190)

BMS3h-217-2307
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTGGTCGTCCTA
CTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1191)

TABLE 4-continued

Human Anti-CD40 Variable Domain Encoding Nucleotide Sequences

BMS3h-217-2308
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTGGGGGTCCTG
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1192)

BMS3h-217-2309
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTGGGCGTCCTG
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1193)

BMS3h-217-2310
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTGGAGCTCCTG
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1194)

BMS3h-217-2311
GACATCCAGATGACCCAGTCTCCATCCTCCCTGTCTGCATCTGTAGGAGACCGTGTCACCATCACTTGCCGGGCAAGTC
ATTGGATTGCCCAGCTGTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1195)

BMS3h-217-2312
GACATCCAGATGACCCAGTCTCCATCCTCCCTGTCTGCATCTGTAGGAGACCGTGTCACCATCACTTGCCGGGCAAGTC
ATTTTATTGGTTCGCTCTTACGCTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1196)

BMS3h-217-2313
GACATCCAGATGACCCAGTCTCCATCCTCCCTGTCTGCATCTGTAGGAGACCGTGTCACCATCACTTGCCGGGCAAGTC
ATCGGATTGCCCAGCTGTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1197)

BMS3h-217-2314
GACATCCAGATGACCCAGTCTCCATCCTCCCTGTCTGCATCTGTAGGAGACCGTGTCACCATCACTTGCCGGGCAAGTC
ATTACATTGCCTCCCTGTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1198)

BMS3h-217-2315
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCCGGTTCGGCTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1199)

BMS3h-217-2316
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTACAAGTCCTA
CTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1200)

BMS3h-217-2317
GACATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTGGGCTCCTA
CTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1201)

BMS3h-217-2318
GACATCCAGATGACCCAGTCTCCATCCTCCCTGTCTGCATCTGTAGGAGACCGTGTCACCATCACTTGCCGGGCAAGTC
ATTTTATTTGGGGGCCCTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTCTGCTACGTACTACTGTGGTCAGGGGGTGCTGTGGCCTGCGACGTTCGGCCAAGGGACAACGGTGGAAA
TCAAACGG (SEQ ID NO: 1202)

TABLE 4-continued

Human Anti-CD40 Variable Domain Encoding Nucleotide Sequences

BMS3h-217-2319
GACATCCAGATGACCCAGTCTCCATCCTCCCTGTCTGCATCTGTAGGAGACCGTGTCACCATCACTTGCCGGGCAAGTC
ATTGGATTGCCACCCTGTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1203)

BMS3h-217-2320
GACATCCAGATGACCCAGTCTCCATCCTCCCTGTCTGCATCTGTAGGAGACCGTGTCACCATCACTTGCCGGGCAAGTC
ATTTTATTTGGGGGCCCTTATCTTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1204)

BMS3h-217-2321
GACATCCAGATGACCCAGTCTCCATCCTCCCTGTCTGCATCTGTAGGAGACCGTGTCACCATCACTTGCCGGGCAAGTC
ATTTTATTGGTAGCCTCTTAAACTGGTACCAGGTGAAACCAGGGAAAGCCCCTAAGCTCCTGATCACTTATGGTTCCTT
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1205)

BMS3h-217-2322
GGCATCCAGATGACCCAGTCTCCATCCTCCCTGTCTGCATCTGTAGGAGACCGTGTCACCATCACTTGCCGGGCAAGTC
ATTTTATTGGTAGTCTGTTATCTTGGTACCAGGTGAAACCAGGGAAAGCCCCTAAGCTCCTGATCACTTACGGGTCCTG
GTTGCAAAGTGGGGTCCCATCACGTTTCAGTGGCAGTGGATCTGGGACAGATTTCACTCTCACCATCAGCAGTCTGCAA
CCTGAAGATTTTGCTACGTACTACTGTGGTCAGGGGGTGCTGTGGCCTGCGACGTTCGGCCAAGGGACAACGGTGGAAA
TCAAACGG (SEQ ID NO: 1206)

Example 1

Generation of Human Anti-CD40 Variable Domains BMS3h-1 Through BMS3h-225

The following example describes the generation of a series of anti-human CD40 variable domains, designated BMS3h-1 through BMS3h-225. Following recombinant expression of a repertoire of single immunoglobulin variable domains on the surface of phage, selection is performed by contacting the phage repertoire with immobilized target antigen, washing to remove unbound phage, and propagating the bound phage. This process frequently referred to as "panning." It is applicable to the screening of single immunoglobulin variable domains, as well as other antibody fragments that can be expressed on a display library, e.g., scFv, Fab, and Fab'. Alternatively, phage may be pre-selected for the expression of properly folded member variants by panning against an immobilized generic ligand (e.g., protein A or protein L) that is only bound by folded members. This has the advantage of reducing the proportion of non-functional members, thereby increasing the proportion of members likely to bind a target antigen. Pre-selection with generic ligands is taught in WO 99/20749, for example. The screening of phage antibody libraries is generally described, for example, by Harrison et al., Meth. Enzymol. 267: 83-109 (1996).

Screening is commonly performed using purified antigen immobilized on a solid support, for example, plastic tubes or wells, or on a chromatography matrix, for example Sepharose™ (Pharmacia). Screening or selection can also be performed on complex antigens, such as the surface of cells (Marks et al., BioTechnology 11: 1145 (1993); de Kruif et al., Proc. Natl. Acad. Sci. USA 92: 3938 (1995)). Another alternative involves selection by binding biotinylated antigen in solution, followed by capture on streptavidin-coated beads.

Clones BMS3h-1 to BMS3h-69:

Three rounds of selections using decreasing concentrations of antigen (100 nM at round 1; 10 nM at round 2; 1 nM at round 3) were performed in parallel against both biotinylated human CD40 monomer (supplied by BMS, 1.5 moles biotin/mole CD40) and biotinylated human CD40-Ig (supplied by BMS, 3.3 moles biotin/mole CD40-Ig). Phage from the naïve 4G and 6G Domantis dAb libraries were combined as follows before initiating selections:

1) 4G+6G $V_H$ CDR3 lengths between 7-9 amino acids.
2) 4G+6G $V_H$ CDR3 lengths between 10-12 amino acids.
3) 4G+6G $V_H$ CDR3 lengths between 13-15 amino acids.
4) 4G VK
5) 6G VK Each round of selection involved adding the desired concentration of antigen to a mixture of 750 µl of phage from one of the naïve library pools or subsequent selection output phage and 750 µl of PBS+2% Marvel (Phosphate Buffered Saline containing 2% (w/v) Marvel [Premier Foods, UK]) and incubating at room temperature for 1 hour by mixing end-over-end. The biotinylated antigen phage complex was then captured by adding 100 µl of resuspended Dynabeads® M-280 Streptavidin [Invitrogen, UK] and incubated for 5 minutes with mixing end-over-end at room temperature. The Dynabeads® were then recovered using a KingFisher magnetic separator [Thermo Fisher Scientific, UK] and washed 7×1 ml PBS+0.1% Tween 20 (PBS containing 0.1% (v/v) polyoxyethylenesorbitan monolaurate [Sigma-Aldrich, UK], PBST) followed by 1×1 ml PBS. Bound phage retained on the washed Dynabeads® were eluted by incubation with 500 µl of trypsin-PBS (50 µl of 10 mg/ml trypsin [Sigma-Aldrich, UK] dissolved in 50 mM Tris-HCl pH 7.4, 1 mM $CaCl_2$ added to 450 µl PBS). The phage-containing solution was recovered and 250 µl used to infect 1.75 ml of logarithmic growth phase E. coli TG1 (at an $OD_{600}$ of 0.4) for 30 minutes at 37° C. The E. coli TG1 phage infected culture was centrifuged at 11,600 g in a micro centrifuge for 1 minute. The resulting cell pellet was resuspended in 1 ml 2×TY (16 g Tryptone, 10 g Yeast Extract and 5 g NaCl in 1 liter, autoclaved for 15 minutes at 121° C.) and plated onto a 9 cm Petri dish containing TY supplemented with 15 μg/ml tetracycline. The plates were incubated overnight at 37° C. Then 2 ml of 2×TY supplemented with 15% glycerol was added to each plate, and the cells were loosened with a glass spreader and mixed thoroughly. Fifty microliters of the scraped bacteria were used to inoculate 50 ml of 2×TY supplemented with 15 μg/ml tetracycline and grown overnight at 37° C. with shaking at 250 rpm. The overnight culture was centrifuged at 3,300 g for 15 min to pellet the bacteria. To precipitate phage, 10 ml PEG/NaCl (20% Polyethylene glycol 8000, 2.5 M NaCl) was added to 40 ml supernatant. The phage/PEG solution was mixed and left on ice for 1 h, then spun at 3,300 g for 30 min at 4° C., and the supernatant discarded. The pellet was resuspended in 2 ml PBS and spun at 11,600 g for 10 min in a micro centrifuge to remove the remaining bacterial debris. The resultant supernatant containing phage was then used for the next round of selection against the appropriate biotinylated CD40 antigen.

Monoclonal phage ELISAs were carried out following selection rounds 2 and 3. All washes were performed using 3 washes of 250 μl PBST followed by 3 washes of 250 μl PBS. The plates were coated overnight at 4° C. with 50 μl/well of 1 μg/ml NeutrAvidin (Thermo Scientific, UK) in 0.2 M carbonate-bicarbonate buffer, pH 9.4. The plates were washed and then blocked with 2% MPBS (2% w/v Marvel skimmed milk powder [Premier Foods] in PBS) for 1 hour at room temperature. The plates were then washed and incubated with 50 μl/well of 0.7 μg/ml biotinylated human CD40 in 2% MPBS. The plates were washed, and phage supernatants were added to an equal volume of 2% MPBS. The plates were then incubated for 1 hour at room temperature. The plates were washed and bound phage detected with anti-M13-HRP conjugate (GE Healthcare, UK) diluted 1:5000 in 2% MPBS and incubated for 1 hour at room temperature. The plates were washed, and the ELISA was developed using SureBlue 1-Component TMB MicroWell Peroxidase solution (KPL Inc, USA). Specific phage were identified by comparison to plates coated with NeutrAvidin but without biotinylated CD40. A MidiPrep was used to isolate dAb V-genes from pDOM4 (Domantis) round 2 and round 3 outputs and cloned into pDOM5 (Domantis). pDOM4, disclosed in WO 2007/085815, is a derivative of the Fd phage vector in which the gene III signal peptide sequence is replaced with the yeast glycolipid anchored surface protein (GAS) signal peptide (WO 2005/093074). pDOM4 also contains a c-myc tag between the leader sequence and gene III, which puts the gene III back in frame.

Binding dAbs were identified as follows. Ninety-six individual colonies (in pDOM5) were picked from each output into 200 μL Terrific Broth containing OnEx Autoinduction media (Novagen, UK) overnight at 37° C. with shaking at 250 rpm in Costar 96 Well Cell Culture Clusters (Corning Incorporated, USA). The cultures were centrifuged to pellet the cells, and the supernatants were assayed by antigen binding ELISA for CD40 binding dAbs. MaxiSorp 96 well immunoplates (Nunc, USA) were coated overnight at 4° C. with 50 μl/well of 1 μg/ml NeutrAvidin in 0.2 M carbonate-bicarbonate buffer, pH 9.4. All washes were as described for the phage ELISA. The plates were blocked for 1 hour at room temperature with 200 μl of PBS containing 1% Tween 20. The plate was then washed and incubated with 50 μl/well of 0.7 μg/ml biotinylated human CD40 in 0.1% PBST. The clarified dAb-containing culture supernatant was added to the ELISA plate with an equal volume of 0.1% PBST. The plates were incubated for 1 hour at room temperature and then washed. Bound dAb was detected using a two step process: firstly 9E10 (anti-myc IgG, Sigma-Aldrich, UK) diluted 1:2000 in 0.1% PBST was added for 1 hour at room temperature then washed, followed by anti-mouse Fc-HRP (Sigma-Aldrich, UK) diluted 1:2000 in 0.1% PBST for 1 hour at room temperature. The plates were washed, and the ELISA was developed using SureBlue 1-Component TMB MicroWell Peroxidase solution (KPL Inc, USA). The color was allowed to develop, and the colorimetric reaction was stopped by the addition of an equal volume of 1 M HCl. The ELISA plate was read at 450 nm. Specific phage were identified by comparison to plates coated with NeutrAvidin but without biotinylated CD40.

Clones specific for CD40 were tested in either the bead- or ELISA-based receptor-binding assay (RBA) to assess for inhibition of CD40 ligand binding. Domain antibodies that showed inhibition in the RBA were tested in the B-cell proliferation assay and then in a variety of other in vitro cell assays. These assays are described in greater detail below. BMS3h-106 to -225:

BMS3h-106 to -225 were isolated from selections against biotinylated CD40 or biotinylated CD40-Fc as described for BMS3h-1 to BMS3h-69, but with the following modifications. Phage from the naïve 4G and 6G libraries were combined as follows before initiating selections:

6) 4G $V_H$ CDR3 lengths between 7-9 amino acids.
7) 4G $V_H$ CDR3 lengths between 10-12 amino acids.
8) 4G $V_H$ CDR3 lengths between 13-15 amino acids.
9) 6G $V_H$ CDR3 lengths between 7-9 amino acids.
10) 6G $V_H$ CDR3 lengths between 10-12 amino acids.
11) 6G $V_H$ CDR3 lengths between 13-15 amino acids.
12) 4G VK
13) 6G VK Round one was performed at an antigen concentration of 160 nM for CD40-Fc and 100 nM for CD40. Output titres were in the range $2.0 \times 10^4$ to $9.0 \times 10^7$ TU/ml (functional viral titre).

For round two, enriched phage from round one were combined in pairs before using in selections:

1) 4G+6G $V_H$ CDR3 lengths between 7-9 amino acids (pools 1+4 from round 1).
2) 4G+6G $V_H$ CDR3 lengths between 10-12 amino acids (pools 2+5 from round 1).
3) 4G+6G $V_H$ CDR3 lengths between 13-15 amino acids (pools 3+6 from round 1).
4) 4G+6G VK (pools 7+8 from round 1)

Selections were performed at an antigen concentration of 100 nM, and the antigen-phage complexes were captured using M-280 tosyl-activated Dynabeads® (Invitrogen) that had been coupled with NeutrAvidin (Thermo Fisher Scientific, UK). Output titres were in the range $6.5 \times 10^7$ to $7.5 \times 10^8$ TU/ml.

Round three was performed at an antigen concentration of 20 nM and, in the case of the CD40-Fc selections, in the presence of 6.7 μM free human Fc tail (BMS). Output titres were in the range $4.3 \times 10^7$ to $1.6 \times 10^9$ TU/ml.

Round four was performed as described for round two but at an antigen concentration of 2 nM and in the presence and absence of 500-fold excess unlabelled CD40-Fc. The addition of this competitor was made after the initial one hour incubation of the phage with the biotinylated antigen, and the mixture was then incubated overnight, as before. This competition step was included with the aim of enhancing selection of dAbs with a slower off-rate. Output titres were in the range $1.8 \times 10^7$ to $4.4 \times 10^7$ without competition and $1.8 \times 10^6$ to $2.3 \times 10^7$ TU/ml with competition.

To monitor the progress of the selections, monoclonal phage ELISAs were carried out following rounds 2 and 3. These were performed as described for BMS3h-1 to BMS3h-69. Binding dAbs were identified as described for BMS3h-1 to BMS3h-69 except that, in the case of the VK library screening, protein L was included at a final concentration of 0.8 µg/ml. Addition of protein L increased the signal strength by cross-linking the dAbs.

BMS3h-70 to -105:

BMS3h-70 to -105 were isolated from selections against antigen that had been passively adsorbed to immunotubes. Phage from the naïve 4G and 6G Domantis dAb libraries were combined as follows before initiating selections:

1) 4G $V_H$ CDR3 lengths between 7-9 amino acids.
2) 4G $V_H$ CDR3 lengths between 10-12 amino acids.
3) 4G $V_H$ CDR3 lengths between 13-15 amino acids.
4) 6G $V_H$ CDR3 lengths between 7-9 amino acids.
5) 6G $V_H$ CDR3 lengths between 10-12 amino acids.
6) 6G $V_H$ CDR3 lengths between 13-15 amino acids.
7) 4G VK
8) 6G VK For the first round of selection, 1 ml of 10 µg/ml human CD40-Fc fusion (BMS) in 0.2 M carbonate-bicarbonate buffer, pH 9.4, was added to a Nunc MaxiSorp immunotube and then incubated overnight at 4° C. with rolling. The tube was then emptied and washed three times with phosphate buffered saline (PBS). The tube was then blocked by filling to the brim with MPBS and incubating for 1 h at room temperature. The tube was then emptied and washed three times with PBS. Library phage in 4 ml MPBS were added to the tube and incubated for 1 hour with rotation end-over-end at room temperature.

The tube was emptied and washed 10 times with PBST (PBS with 0.1% (v/v) Tween 20). Bound phage retained on the washed tube were eluted by incubation with 500 µl of trypsin-PBS (50 µl of 10 mg/ml trypsin [Sigma-Aldrich, UK] dissolved in 50 mM Tris-HCl pH 7.4, 1 mM $CaCl_2$ added to 450 µl PBS) with rotation end-over-end for 10 min at room temperature. The phage-containing solution was recovered, and 250 µl were used to infect 1.75 ml of logarithmic growth phase E. coli TG1 (at an $OD_{600}$ of 0.4) for 30 minutes at 37° C. The E. coli TG1 phage infected culture was centrifuged at 11,600 g in a microcentrifuge for 1 min, and the resulting cell pellet was re-suspended in 1 ml 2×TY (16 g Tryptone, 10 g Yeast Extract, and 5 g NaCl in 1 liter. The suspension was autoclaved for 15 minutes at 121° C.) and plated onto a 9 cm Petri dish containing LB agar supplemented with 15 µg/ml tetracycline. The plates were incubated overnight at 37° C. Two milliliters of 2×TY supplemented with 15% glycerol was then added to each plate, and the cells were loosened with a glass spreader and mixed thoroughly.

Fifty microliters of the scraped bacteria were used to inoculate 50 ml of 2×TY supplemented with 15 µg/ml tetracycline and grown overnight at 37° C. with shaking at 250 rpm. The overnight culture was centrifuged at 3,300 g for 15 min to pellet the bacteria. To precipitate phage, 10 ml PEG/NaCl (20% Polyethylene glycol 8000, 2.5 M NaCl) was added to 40 ml supernatant. The phage/PEG solution was mixed and left on ice for 1 h. The solution was then spun at 3,300 g for 30 min at 4° C., and the supernatant was discarded. The pellet was re-suspended in 2 ml PBS and spun at 11,600 g for 10 min in a micro centrifuge to remove the remaining bacterial debris. The resultant supernatant containing phage was then used for the next round of selection against CD40-Fc antigen. Output titres from round one were in the range $7.5 \times 10^4$ to $1.5 \times 10^7$ TU/ml (transforming units per ml).

A second round of selection was performed using enriched phage recovered from the first round of selection. This was performed exactly as described above and the output titres were in the range $2.5 \times 10^7$ to $1.2 \times 10^8$ TU/ml.

A third round of selection was performed using enriched phage recovered from the second round of selection. These were performed as described above but with an antigen concentration of 1 µg/ml. Output titres were in the range $5.1 \times 10^7$ to $7.5 \times 10^8$ TU/ml.

To monitor the progress of the selections, monoclonal phage ELISAs were carried out following rounds 2 and 3. A sample of individual colonies were picked into 200 µl 2×TY supplemented with 15 µg/ml tetracycline and incubated overnight at 37° C. with shaking at 250 rpm in Costar 96 Well Cell Culture Clusters (Corning Incorporated, USA). The cultures were centrifuged to pellet the cells, and the supernatants were assayed by antigen binding ELISA for CD40-binding phage dAbs. All washes were performed using 3 washes of 250 µl PBST followed by 3 washes of 250 µl PBS. MaxiSorp 96 well immunoplates (Nunc, USA) were coated overnight at 4° C. with 50 µl/well of 0.5 µg/ml CD40-Fc (BMS) in 0.2 M carbonate-bicarbonate buffer, pH 9.4. The plates were washed and then blocked with 250 µl of 2% MPBS for 1 hour at room temperature. The plates were washed, and phage supernatants were added to an equal volume of 2% MPBS and incubated for 1 hour at room temperature. The plates were washed, and bound phage were detected with anti-M13-HRP conjugate (GE Healthcare, UK) diluted 1:5000 in 2% MPBS and incubated for 1 hour at room temperature. The plates were washed, and the ELISA was developed using SureBlue 1-Component TMB MicroWell Peroxidase solution (KPL Inc, USA). Specific phage dAbs were identified by comparison to plates coated with free Fc.

The dAb genes from each of the above rounds two and three selection outputs were sub-cloned, as a pool, into soluble expression vector pDOM5 in E. coli strain HB2151. This vector allowed expression of free dAb with a c-myc tag (Roche Diagnostics GmbH) in E. coli and secretion to the supernatant.

CD40-binding dAbs from passive selections were identified as follows. Ninety-six individual colonies (in pDOM5) were picked from each output into 200 µL Terrific Broth containing OnEx Autoinduction media (Novagen, UK) overnight at 37° C. with shaking at 250 rpm in Costar 96 Well Cell Culture Clusters (Corning Incorporated, USA). The cultures were centrifuged to pellet the cells, and the supernatants were assayed by antigen binding ELISA for CD40 binding dAbs. MaxiSorp 96 well immunoplates (Nunc, USA) were coated overnight at 4° C. with 50 µl/well of 0.5 µg/ml CD40-Fc (BMS) in 0.2 M carbonate-bicarbonate buffer, pH 9.4. All washes were as described for the phage ELISA. The plates were blocked for 1 hour at room temperature with 250 µl of PBS containing 1% Tween 20 (PBST). The clarified dAb-containing culture supernatant was added to the ELISA plate with an equal volume of 0.1% PBST. The plates were incubated for 1 hour at room temperature and then washed. Bound dAb was detected using a two step process: firstly biotinylated 9E10 (anti-myc IgG, Sigma-Aldrich, UK) diluted 1:2000 in 0.1% PBST was added for 1 hour at room temperature then washed, followed by streptavidin-HRP (Bender MedSystems, Austria) diluted 1:5000 in 0.1% PBST for 1 hour at room temperature. The plates were washed and the ELISA developed using Sure- Blue 1-Component TMB. Specific dAbs were identified by comparison to plates coated with free Fc.

Clones specific for CD40 were tested in either the bead- or ELISA-based receptor-binding assay (RBA) to assess for inhibition of CD40 ligand binding. The potency measurements obtained from the RBA are given in Table 5 (Primary Screening effort). Domain antibodies that showed inhibition in the RBA were tested in the B-cell proliferation assay and then in a variety of other in vitro cell assays.

BMS3h-210 to -225

BMS3h-210 to -225 were isolated from selections against whole cells. Phage from the naïve 4G and 6G Domantis dAb libraries were combined as follows before initiating selections:

1) 4G+6G $V_H$ CDR3 lengths between 7-9 amino acids.
2) 4G+6G $V_H$ CDR3 lengths between 10-12 amino acids.
3) 4G+6G $V_H$ CDR3 lengths between 13-15 amino acids.
4) 4G and 6G VK For round one a DG44 CHO cell line stably transfected with cell-surface expressed human CD40 (supplied by BMS) was used as antigen. Prior to selection against these cells, the library pools outlined above were incubated with non-transfected CHO cells to deplete them of phage displaying dAbs specific for cell surface antigens other than CD40. Both types of cells were harvested by incubation with Versene (Invitrogen) before assessing for viability. Six million viable non-transfected CHO cells were re-suspended in 4 ml PBS with 2% (w/v) BSA (PBS/BSA) and rotated end-over-end at 4° C. for 1 hour to block. All subsequent steps were performed at 4° C. unless otherwise noted. The cells were centrifuged at 185 g for 5 min and the supernatant, containing the depleted library phage, transferred to a fresh tube. To this were added $6\times10^6$ viable CHO-CD40 cells in 1 ml PBS/BSA and the mixture was rotated for 1 hour. The cells were then washed five times by centrifuging at 185 g for 5 min and re-suspending in 10 ml PBS/BSA. After the final wash, the cells were pelleted as previously and were then resuspended in 0.5 ml of 1 mg/ml trypsin type XIII from bovine pancreas (Sigma Aldrich, UK) in PBS supplemented with 5 mM Tris-HCl pH 7.4, 0.1 mM $CaCl_2$ and transferred to a microcentrifuge tube. The cells were rotated at room temperature for 10 min before centrifuging at 16000 g for 5 min. Eluted phage in the supernatant were used to infect $E.$ $coli$ and the output phage titres were determined to be between $5.1\times10^5$ and $2.7\times10^6$ TU/ml (transforming units per ml).

A second round of selection was performed using enriched phage recovered from the first round of selection. These were performed as above but without the initial depletion (de-selection) step and using RAMOS human B cells (ATCC) instead of CHO-CD40. Output titres were in the range $2.3\times10^5$ to $7.5\times10^5$ TU/ml.

A third round of selection was performed as for the second round. Output titres were in the range $1.9\times10^8$ to $3.5\times10^8$ TU/ml.

The dAb genes from each of the above rounds two and three selection outputs were sub-cloned, as a pool, into soluble expression vector pDOM5 in $E.$ $coli$ strain HB2151. This vector allowed expression of free dAb with a c-myc tag in $E.$ $coli$ and secretion to the supernatant.

Clones specific for CD40 were tested in either the CHO cell receptor-binding assay (RBA) to assess for inhibition of CD40 ligand binding. Domain antibodies that showed inhibition in the RBA were tested in the B-cell proliferation assay and then in a variety of other in vitro cell assays.

Affinity Maturation by Error-Prone PCR

Error-prone phage libraries were constructed for 13 BMS3h dAbs that showed neutralization activity in the B-cell proliferation assay described below in Example 6 (See TABLE 17). This was performed by using Mutazyme II polymerase (part of the GeneMorph II kit from Agilent Technologies) to randomly introduce errors into the dAb gene during amplification by polymerase chain reaction (PCR). The mutated dAb genes were cloned as a genetic fusion with the fd phage gene III protein under the control of the GAS 1 leader sequence in pDOM4 vector, which contained all the fd genes necessary to generate infective phage particles. These libraries were approximately $1\times10^8$ CFU (colony forming units) in size, with an error-rate of 2-5 amino acids per dAb gene.

Phage generated from these libraries were subjected to three rounds of selection against soluble biotinylated human CD40. The first round of phage selection was performed by premixing the phage library with 2% MPBS (phosphate buffered saline supplemented with 2% (w/v) Marvel dried skimmed milk powder) and adding biotinylated human CD40 (BMS) to a final concentration of 20 nM in a final volume of 1 ml. The mixture was incubated for at least one hour at room temperature with mixing end-over-end. The antigen-phage complexes were then captured using 50 µl of M-280 streptavidin Dynabeads® (Invitrogen) and washed 7 times with 1 ml PBST followed by a single wash in 1 ml PBS. The washed phage were eluted from the antigen/bead complex by incubating with 0.5 ml of 1 mg/ml trypsin type XIII from bovine pancreas (Sigma Aldrich, UK) in PBS supplemented with 5 mM Tris-HCl pH 7.4, 0.1 mM $CaCl_2$. Eluted phage were used to infect $E.$ $coli$ and the output phage titres were determined to be between $2\times10^5$ and $9\times10^7$ TU/ml (transforming units per ml).

A second round of selection was performed using enriched phage recovered from the first round of selection, with a final concentration of 2 nM biotinylated CD40 followed by capture using streptavidin beads as described above. Output titres were in the range $3\times10^4$ to $5\times10^6$ TU/ml.

A third round of selection using 2 nM biotinylated CD40 followed by capture using streptavidin beads was performed. The eluted phage titres were in the range $8\times10^4$ to $4\times10^6$ TU/ml.

BIAcore™ Screening

The dAb genes from each of the above round three selection outputs were sub-cloned, as a pool, into soluble expression vector pDOM13 (Domantis) in $E.$ $coli$ HB2151. The pDOM13 vector is also known as pDOM33 and is disclosed in WO/2008/149143. This vector allowed expression of free dAb in $E.$ $coli$ and secretion to the supernatant. Forty-seven individual colonies were picked from each of the outputs and expressed in 200 µl Terrific Broth (TB) containing Novagen Overnight Express Autoinduction media (Merck Chemicals, UK) overnight at 37° C. with shaking at 250 rpm in Costar 96 Well Cell Culture Clusters (Corning Incorporated, USA). In the same plate, a single well was inoculated with $E.$ $coli$ expressing the appropriate parental (wild-type) dAb. The cultures were centrifuged to pellet the cells and the supernatants screened on a BIAcore™ 3000 instrument (GE Healthcare) for improvements in "off-rate" (i.e. dissociation rate constant, $k_d$) compared to parental dAb.

Approximately 1600 response units (RU) of biotinylated human CD40 (BMS) were immobilized on one flow-cell of a streptavidin (SA) BIAcore™ chip. A second flow cell without any ligand immobilized served as a reference flow-cell for inline referencing. Each dAb supernatant to be analyzed was diluted 1:3 in HBS-EP buffer (0.01 M HEPES pH 7.4 with 0.15 M NaCl, 3 mM EDTA and 0.005% v/v Surfactant P20, GE Healthcare). Ten microliters of each dAb supernatant were injected, using the instrument's KINJECT function, across the CD40-immobilized and reference flow-cells in series, with inline subtraction of the signal from the reference cell. The experiment was performed at 25° C. and with a flow rate of 10 μl/min of HBS-EP. After each injection had been completed, the dAb was allowed to dissociate from the ligand in buffer for 120 s before regeneration with a 5 μl injection of 10 mM glycine pH 2.0. BIAevaluation 4.1 software (GE Healthcare) was used to subtract the reference flow-cell trace from each analyte trace. The same software was used to perform an approximate fit of a 1:1 (Langmuir) kinetic model to the dissociation phase of the analyte traces. This model yielded approximate dissociation rate constants ("off-rate" or $k_d$) for each clone and allowed relative comparisons to be made with the wild type dAb.

Clones with improved off-rates were identified for all lineages except BMS3h-129 and -197. Clones with improved off-rates were tested in either the bead- or ELISA-based receptor-binding assay (RBA) to assess for improved potency as described above. The potency measurements obtained from the RBA are given in the Tables labeled "Error-Prone-Matured Clones." Clones that were more potent in the RBA were subsequently tested in a B-cell proliferation assay to assess for enhanced biological potency and these measurements obtained are given in TABLE 17. Domain antibodies that had improved potency in the B-cell proliferation assay were also tested in a variety of other in vitro cell assays.

Affinity Maturation by Triplet Scanning Diversification

Five improved-potency dAbs isolated from the error-prone maturation, BMS3h-37-2, -38-2, -56-2, -193-25 and -217-23, were chosen to be further affinity matured by triplet scanning diversification. Phage libraries were constructed based on these parents as described above for the error-prone libraries except that, instead of using error-prone PCR, a series of overlapping degenerate triplet oligonucleotides were used to diversify the complementarity determining (CDR) regions of each dAb. For each dAb to be affinity matured, oligonucleotides containing NNS codon triplets (see Arkin et al. (1992) *Proc. Nat'l Acad. Sci. USA* 89:7811-7815) were used to make a number of libraries for each CDR by slicing by overlap extension (SOE) PCR. The triplets diversified by the oligonucleotides for a given CDR overlapped by two codons, resulting in two to four libraries per CDR. The amino acid residues diversified in the BMS3h-37-2 libraries were at positions 30, 31, 32, 33, 35, 50, 52, 53, 55, 56, 95, 96, 97, and 98 (Kabat numbering). The residues diversified in the BMS3h-38-2 libraries were as for 37-2, but with the addition of position 100. The residues diversified in the BMS3h-56-2 libraries were as for 37-2, but with the addition of positions 100 and 101. The residues diversified in the BMS3h-193-25 and -217-23 libraries were at positions 27, 28, 30, 31, 32, 34, 49, 50, 51, 53, 89, 91, 92, 93, 94, and 96.

Phage generated from these libraries were pooled by CDR and selections performed as described above, except that, for BMS3h-37-2, -38-2, -56-2 and -193-25, the concentrations of antigen used were 10, 1 and 0.1 nM for rounds one, two and three, respectively. For BMS3h-217-23 the concentrations of antigen used were 20, 2 and 0.2 nM for rounds one, two and three, respectively. For BMS3h-193-25, which is cross-reactive for cynomolgus CD40, selections were also performed against cyno CD40 in parallel. Additionally, selection rounds two and three were performed in the presence and absence of 100- or 1000-fold excess unlabelled CD40, respectively. The addition of this competitor was made after the initial one hour incubation of the phage with the biotinylated antigen and the mixture was then incubated, as before, for a further hour. This competition step was included with the aim of enhancing selection of dAbs with a slower off-rate. Round one titres were in the range $1.4 \times 10^6$ to $1.4 \times 10^9$. Titres in round 2 were $1.3 \times 10^5$ to $4.0 \times 10^8$ without competition and $8.6 \times 10^4$ to $1.3 \times 10^8$ with competition. Titres in round 3 were $1.2 \times 10^5$ to $1.9 \times 10^8$ without competition and $6.0 \times 10^5$ to $1.2 \times 10^8$ with competition.

These selection outputs were sub-cloned and screened as described for the error-prone affinity maturation. Clones with improved off-rates were identified for all lineages except BMS3h-193-25. Clones with improved off-rates were tested in the ELISA receptor-binding assay (RBA) to assess for improved potency. The potency measurements obtained from the RBA are given in the Tables labeled "Further-Matured Clones." Clones that were more potent in the RBA were subsequently tested in a B-cell proliferation assay to assess for enhanced biological potency and these measurements obtained are given in TABLE 17. Domain antibodies that had improved potency in the B-cell proliferation assay were also tested in a variety of other in vitro cell assays.

Example 2

Screening Using Receptor Binding Assays (RBA)

Several in vitro receptor binding assays (RBA) were used to determined CD40 affinity of the anti-human CD40 variable domain amino acid sequences generated in Example 1. Three RBA formats were used: (1) a bead RBA, (2) an ELISA RBA, and (3) a CHO cell RBA.

Bead RBA:

Phosphate buffered saline (PBS) washed Sphero streptavidin polystyrene particles (Saxon Europe, UK) were coated with 0.5 μg/ml biotinylated human IZ-CD40L (BMS). After coating, biotinylated CD40L particles were washed in PBS and diluted 1:10 in 0.1% (w/v) bovine serum albumin (BSA) (Sigma-Aldrich, UK) in PBS assay buffer. In a 384-well clear bottom, black walled plate (Applied Biosystems) a dilution range of purified dAb, 0.25 μg/ml human CD40 (BMS, CY24FEB06-01), 1 in 5000 mouse anti-human IgG (Fc) mAb clone GG-7 (Sigma-Aldrich, UK), 0.25 μg/ml goat anti-mouse ALEXA Fluor 647 (Invitrogen, Molecular probes, UK) and the biotinylated CD40L polystyrene particles were combined equally and allowed to incubate at room temperature for 6 hours in the absence of light. Following incubation, competitive binding of dAb vs. human CD40 to biotinylated CD40L particles was assessed using relative fluorescence with the AB8200 cellular detection mechanism (Applied Biosystems).

ELISA RBA:

Clear walled High Bind, 384-well plates (Corning, UK) were coated with 25 μl of 1 μg/ml Neutravidin in 0.2 M carbonate-bicarbonate buffer, pH 9.4 overnight at 4° C. The following day, assay plates were washed with 0.1% (v/v) Tween PBS buffer, blocked with 1% (w/v) BSA in PBS for 1 hour at room temperature and washed again. Following removal of excess washing buffer, 25 μl 1 μg/ml of biotinylated human IZ-CD40L (BMS) was incubated with the assay plates for 1 hour at room temperature. Simultaneously, a dilution range of purified dAb and 1 µg/ml of human CD40 (BMS, CY24FEB06-01) were complexed in a 1:1 ratio. Following washing of the assay plate, the dAb:human CD40 complex was incubated in the assay plate at room temperature for 2 hours with gentle agitation. Competitive binding of dAb vs. human CD40 to biotinylated CD40L was detected with sequential incubations of 1 in 5000 mouse anti-human IgG (Fc) mAb clone GG-7 (Sigma-Aldrich, UK) followed by 1 in 10,000 horse radish peroxidase (HRP) conjugated goat anti-mouse IgG (Fc) secondary detection antibody (Sigma-Aldrich, UK). Absorbance signal was measured using a SpectraMax M5$^e$ plate reader (Molecular Devices) at 450 nm following neutralization with 1M HCl solution.

Cell Assays: CD40 CHO Cell RBA:

Stably transfected human CD40 expressing CHO-DG44 cells or native CHO-DG44 cells (both BMS) were detached from cell culture flasks using Versene (Invitrogen). Forty thousand cells per well were seeded into 96-well High Bind, black walled, clear bottom plates (Corning, UK) in 0.1% (w/v) BSA PBS assay buffer with a dilution range of dAb, 0.25 µg/ml of biotinylated human IZ-CD40L (BMS), and 0.25 µg/ml of streptavidin Alexa Fluor 647 (Invitrogen, Molecular probes, UK). The mixture was incubated in the absence of light for 6 hours. Following incubation, competitive binding of dAb vs. human CD40 CHO cells to soluble biotinylated IZ-CD40L was assessed using relative fluorescence with the AB8200 cellular detection mechanism (Applied Biosystems).

TABLES 5-7 respectively show the results from a primary screening effort ("naïve clones") and subsequent rounds of affinity maturation ("error-prone matured clones" and "further-matured clones") for the tested anti-human CD40 dAbs.

TABLE 5

Primary Screening Effort:

| Naïve Clone | $EC_{50}$ Bead RBA (nM) | $EC_{50}$ ELISA RBA-(nM) | $EC_{50}$ cell RBA (CHO-CD40) (nM) |
|---|---|---|---|
| BMS3h-37 | 100, 200 | | |
| BMS3h-38 | 600, 650 | | >10000 |
| BMS3h-41 | 2000, 1600 | | >10000 |
| BMS3h-43 | 100, 50, 50 | | 5000 |
| BMS3h-56 | 1000, 500 | | |
| BMS3h-106 | 300, 1000, 500, 400 | | >10000 |
| BMS3h-129 | 5000 | | |
| BMS3h-131 | 500, >1000 | | |
| BMS3h-193 | 1000 | | |
| BMS3h-197 | 30 | | |
| BMS3h-198 | 80 | | 600 |
| BMS3h-202 | 3000, 3700 | | >10000 |
| BMS3h-217 | 800 | | 1400 |
| BMS3h-231 | | 670, 870 | |
| BMS3h-233 | | 2770 | |
| BMS3h-257 | | 3210, 1340 | |
| BMS3h-242 | | 390, 210 | |
| BMS3h-262 | | 1770, 1160 | |
| BMS3h-263 | | 3130 | |
| BMS3h-271 | | 370, 210 | |
| BMS3h-285 | | 168, 258 | |
| BMS3h-287 | | >10000, 6758 | |
| BMS3h-289 | | 2390, >10000 | |

TABLE 6

Error-Prone-Matured Clones:

| Clone | $EC_{50}$ ELISA RBA (nM) | $EC_{50}$ cell RBA (CHO-CD40) (nM) |
|---|---|---|
| BMS3h-37-2 | | 32 |
| BMS3h-37-4 | | 45 |
| BMS3h-37-11 | | 27 |
| BMS3h-38-5 | | 1000 |
| BMS3h-38-8 | | 2800 |
| BMS3h-41-3 | | 200 |
| BMS3h-41-10 | | 4300 |
| BMS3h-43-3 | | 320 |
| BMS3h-43-5 | | 90 |
| BMS3h-56-1 | 7.1 | |
| BMS3h-56-2 | 17.0 | |
| BMS3h-56-5 | 4.9, 7.5, 4.7 | 18, 28 |
| BMS3h-56-7 | 5.5 | |
| BMS3h-56-8 | 6.2 | |
| BMS3h-56-9 | 4.4,5.5 | |
| BMS3h-56-16 | 7.0 | |
| BMS3h-56-17 | 66 | |
| BMS3h-56-18 | 6.5 | |
| BMS3h-56-19 | 5.5,5.1 | |
| BMS3h-56-20 | 6.8 | |
| BMS3h-56-21 | 6.5,6.2 | |
| BMS3h-56-22 | 6.5 | |
| BMS3h-56-23 | 24.5 | |
| BMS3h-56-24 | 11.7 | |
| BMS3h-56-25 | 5.5 | |
| BMS3h-56-26 | 5.0 | |
| BMS3h-56-27 | 16.3 | |
| BMS3h-56-28 | 8.9 | |
| BMS3h-56-29 | 9.7 | |
| BMS3h-56-30 | 24.2 | |
| BMS3h-56-31 | 61.0 | |
| BMS3h-193-5 | >300 | |
| BMS3h-193-7 | 300 | |
| BMS3h-193-10 | 200 | |
| BMS3h-193-11 | 300 | |
| BMS3h-193-12 | 200 | |
| BMS3h-193-15 | | 300 |
| BMS3h-193-18 | 100 | |
| BMS3h-193-19 | 100 | |
| BMS3h-193-25 | 140 | |
| BMS3h-193-26 | 100 | |
| BMS3h-193-27 | 100 | |
| BMS3h-193-29 | 360, 114 | |
| BMS3h-193-30 | 290, 116 | |
| BMS3h-198-1 | 12 | 70 |
| BMS3h-198-2 | | 115 |
| BMS3h-198-3 | | 330 |
| BMS3h-198-9 | 20 | |
| BMS3h-198-10 | 35 | |
| BMS3h-198-11 | 20 | |
| BMS3h-198-14 | 9 | |
| BMS3h-198-17 | 20 | |
| BMS3h-198-19 | 7.9 | |
| BMS3h-198-22 | 10 | |
| BMS3h-198-31 | 6.1 | |
| BMS3h-198-32 | 24.7 | |
| BMS3h-198-33 | 8.7 | |
| BMS3h-198-34 | 32.6 | |
| BMS3h-198-37 | 15.1 | |
| BMS3h-198-38 | 7.2 | |
| BMS3h-202-10 | | 7200 |
| BMS3h-202-11 | | 8300 |
| BMS3h-217-1 | 23 | |
| BMS3h-217-2 | 78 | |
| BMS3h-217-3 | 32 | |
| BMS3h-217-4 | partial, 15 | |
| BMS3h-217-5 | 65 | |
| BMS3h-217-6 | 26 | |
| BMS3h-217-7 | 39 | |
| BMS3h-217-8 | 6 | |
| BMS3h-217-9 | 53 | |
| BMS3h-217-14 | 8 | |
| BMS3h-217-15 | 21 | |
| BMS3h-217-16 | 9 | |

TABLE 6-continued

Error-Prone-Matured Clones:

| Clone | EC$_{50}$ ELISA RBA (nM) | EC$_{50}$ cell RBA (CHO-CD40) (nM) |
|---|---|---|
| BMS3h-217-17 | 60 | |
| BMS3h-217-23 | 16 | |

TABLE 7

Further-Matured Clones:

| Clone | EC$_{50}$ ELISA RBA (nM) | EC$_{50}$ ICAM1 cell assay (nM) | EC$_{50}$ cell RBA (CHO-CD40) (nM) |
|---|---|---|---|
| BMS3h-37-202 | 4.1, 35 | | |
| BMS3h-37-205 | 3.1, 4.4 | | |
| BMS3h-37-206 | 3.2, 8.9 | | |
| BMS3h-37-207 | 2.5, 6.6 | | |
| BMS3h-37-212 | 24 | | |
| BMS3h-37-213 | 16 | | |
| BMS3h-38-201 | 3.4, inactive | | |
| BMS3h-38-202 | 4.8 | | |
| BMS3h-38-203 | 5.5 | | |
| BMS3h-38-204 | 4.8 | | |
| BMS3h-38-205 | 4.5, 11.1 | | |
| BMS3h-38-209 | 10.2 | | |
| BMS3h-38-211 | 2.3, 13.8 | | |
| BMS3h-38-215 | 2.3, 3.6 | | |
| BMS3h-38-217 | 1.8, 2.2 | | |
| BMS3h-38-218 | 3.0 | | |
| BMS3h-38-219 | 1.8, 7.1 | | |
| BMS3h-38-223 | 5.7 | | |
| BMS3h-38-224 | 6.3 | | |
| BMS3h-38-225 | 8.8 | | |
| BMS3h-38-226 | 18.1 | | |
| BMS3h-38-228 | 4 | | |
| BMS3h-38-231 | 4.4 | | |
| BMS3h-38-235 | 1.5 | | |
| BMS3h-38-237 | 2 | | |
| BMS3h-38-238 | 5.1 | | |
| BMS3h-56-201 | 3.7, 2.3 | 10.0 | |
| BMS3h-56-202 | 3.4, 3.2 | 80.0 | |
| BMS3h-56-203 | 5.2, 4.3 | 70.0 | |
| BMS3h-56-204 | 4.5 | | |
| BMS3h-56-205 | 9.0 | | |
| BMS3h-56-206 | 2.9, 2.3 | 5.0 | |
| BMS3h-56-207 | 7.3 | | |
| BMS3h-56-215 | 3.2, 4.6 | 40.0 | |
| BMS3h-56-217 | 2.1, 12.6 | | |
| BMS3h-56-220 | 4.2 | | |
| BMS3h-56-223 | 5.0 | | |
| BMS3h-56-224 | 2.1, 4.2 | | |
| BMS3h-56-225 | 2.9 | | |
| BMS3h-56-229 | 4.1 | | |
| BMS3h-56-232 | 2.8, 3.7 | | |
| BMS3h-56-239 | 2.7 | | |
| BMS3h-56-243 | 9.9 | | |
| BMS3h-56-244 | 6.0 | | |
| BMS3h-56-246 | 11.1 | | |
| BMS3h-56-248 | 0.7 | | |
| BMS3h-56-253 | 1.3 | | |
| BMS3h-56-258 | 5.2 | 23.0 | 15 |
| BMS3h-56-261 | 5.7 | 42.4 | 17 |
| BMS3h-56-262 | 4.0 | 135.0 | 42 |
| BMS3h-56-265 | 18.8 | 289.0 | 88 |
| BMS3h-56-266 | 3.8 | 31.9 | 27 |
| BMS3h-56-269 | 3.3 | 34.2 | 24 |
| BMS3h-56-270 | 11.3 | 93.8 | 91 |
| BMS3h-193-2501 | 114 | | |
| BMS3h-193-2502 | 170 | | |
| BMS3h-193-2503 | 3000 | | |
| BMS3h-193-2504 | 140 | | |
| BMS3h-193-2505 | 500 | | |
| BMS3h-193-2506 | 180 | | |
| BMS3h-193-2507 | 160 | | |
| BMS3h-193-2510 | 170 | | |
| BMS3h-193-2511 | 270 | | |
| BMS3h-193-2512 | 600 | | |
| BMS3h-193-2513 | 130 | | |
| BMS3h-193-2514 | 525 | | |
| BMS3h-193-2515 | 100 | | |
| BMS3h-193-2516 | 100 | | |

Example 3

CD40 Binding Kinetics

The binding kinetics were determined for anti-human CD40 dAbs identified in the primary screening effort ("naïve clones") and subsequent rounds of affinity maturation ("error-prone matured clones"). The methods used directly measure the affinity of the dAbs for CD40.

A BIAcore™ 3000 instrument (GE Healthcare) was used to analyze the binding kinetics of CD40-specific dAbs to CD40. Approximately 600 response units (RU) of biotinylated human CD40 (BMS) were immobilized on one flow-cell of a streptavidin (SA) BIAcore™ chip. A second flow cell without any ligand immobilized served as a reference flow-cell for inline referencing. An appropriate doubling dilution series of each dAb to be analyzed was prepared in HBS-EP buffer (0.01 M HEPES pH 7.4 with 0.15 M NaCl, 3 mM EDTA and 0.005% v/v Surfactant P20, GE Healthcare). One hundred and eighty microliters of each dAb were injected in duplicate using the instrument's KINJECT function. Each dAb was injected across the CD40-immobilised and reference flow-cells in series with inline subtraction of the signal from the reference cell. The experiment was performed at 25° C. and a flow rate of 30 µl/min of HBS-EP. After each injection had been completed, the dAb was allowed to dissociate from the ligand in buffer for 300 s before regeneration with a 10 µl injection of 10 mM glycine pH 2.0. A reference injection of HBS-EP buffer blank (containing no analyte) was also injected under the same conditions, to serve as a second reference for subtraction from each analyte trace. BlAevaluation 4.1 software (GE Healthcare) was used to subtract both the reference flow-cell trace and the buffer blank trace from each analyte trace. The same software was used to perform a simultaneous, global fit of a 1:1 (Langmuir) kinetic model to the association and dissociation phases of the analyte dilution series traces. This model yielded association and dissociation rate constants ($k_a$ and $k_d$, respectively) and the equilibrium dissociation constant ($K_D$) of the interaction; these are detailed in TABLES 8 and 9.

TABLE 8

Naïve Clones:

| Clone | BIAcore™ $k_a$ (M$^{-1}$ s$^{-1}$) | BIAcore™ $k_d$ (s$^{-1}$) | BIAcore™ $K_D$ (M) |
|---|---|---|---|
| BMS3h-37 | 1.9E+04 | 3.6E−03 | 1.9E−07 |
| BMS3h-38 | 2.1E+04 | 6.2E−03 | 3.0E−07 |

TABLE 8-continued

Naïve Clones:

| Clone | BIAcore™ $k_a$ (M$^{-1}$ s$^{-1}$) | BIAcore™ $k_d$ (s$^{-1}$) | BIAcore™ $K_D$ (M) |
|---|---|---|---|
| BMS3h-41 | 9.9E+03 | 8.3E-03 | 8.4E-07 |
| BMS3h-43 | 1.4E+03 | 3.1E-03 | 2.1E-06 |
| BMS3h-56 | 2.3E+04 | 4.0E-03 | 1.8E-07 |
| BMS3h-106 | 1.3E+05 | 4.6E-02 | 3.5E-07 |
| BMS3h-107 | 2.0E+05 | 1.7E-01 | 8.5E-07 |
| BMS3h-129 | 4.7E+05 | 5.1E-01 | 1.1E-06 |
| BMS3h-131 | 2.4E+04 | 2.2E-02 | 9.3E-07 |
| BMS3h-197 | 8.1E+04 | 1.4E-02 | 1.8E-07 |
| BMS3h-198 | 1.6E+03 | 3.8E-04 | 2.4E-07 |
| BMS3h-202 | 1.7E+03 | 3.5E-03 | 2.0E-06 |

TABLE 9

Error-Prone Matured Clones:

| Clone | BIAcore™ $k_a$ (M$^{-1}$ s$^{-1}$) | BIAcore™ $k_d$ (s$^{-1}$) | BIAcore™ $K_D$ (M) |
|---|---|---|---|
| BMS3h-37-2 | 1.0E+05 | 4.1E-04 | 4.0E-09 |
| BMS3h-37-5 | 3.9E+04 | 2.2E-04 | 5.5E-09 |
| BMS3h-37-9 | 1.5E+04 | 1.8E-04 | 1.2E-08 |
| BMS3h-38-1 | 3.2E+04 | 1.1E-03 | 3.3E-08 |
| BMS3h-38-2 | 6.1E+04 | 7.5E-04 | 1.2E-08 |
| BMS3h-38-3 | 7.5E+04 | 4.1E-04 | 5.5E-09 |
| BMS3h-41-1 | 5.1E+04 | 5.6E-04 | 1.1E-08 |
| BMS3h-43-1 | 4.4E+03 | 6.3E-04 | 1.4E-07 |
| BMS3h-43-3 | 3.1E+04 | 5.9E-04 | 1.9E-08 |
| BMS3h-56-1 | 9.8E+04 | 5.4E-04 | 5.5E-09 |
| BMS3h-56-2 | 1.1E+05 | 6.0E-04 | 5.3E-09 |
| BMS3h-56-5 | 1.1E+05 | 6.3E-04 | 5.9E-09 |
| BMS3h-56-7 | 1.3E+05 | 4.7E-04 | 3.5E-09 |
| BMS3h-56-9 | 1.5E+05 | 3.9E-04 | 2.6E-09 |
| BMS3h-131-2 | 7.9E+04 | 1.7E-03 | 2.1E-08 |
| BMS3h-193-25 | 4.6E+05 | 3.7E-02 | 8.1E-08 |
| BMS3h-198-1 | 1.5E+04 | 1.8E-04 | 1.3E-08 |
| BMS3h-202-5 | 4.4E+03 | 1.3E-03 | 3.0E-07 |

Example 4

Biophysical Characterization

Anti-human CD40 dAbs identified in the primary screening effort ("naïve clones") and subsequent rounds of affinity maturation ("error-prone matured clones" and "further-matured clones") were further characterized by analysis of biophysical parameters. To measure the relative stability of the dAbs, their melting point was determined by differential scanning calorimetry (DSC). dAbs with a higher melting temperature are more stable. To determine whether the dAbs form multimeric aggregates in solution, the dAbs were assayed by size exclusion chromatography/multiangle laser light scattering (SEC-MALLS). The results are shown in TABLES 10-12.

TABLE 10

Naïve clones:

| Clone | DSC (Tm/° C.) | SEC-MALS solution state |
|---|---|---|
| BMS3h-38 | 59 | Monomer and dimer (<5%) |
| BMS3h-41 | 59 | Monomer and monomer-dimer equilibrium (<5%) |
| BMS3h-43 | | Dimer and trimer |
| BMS3h-56 | 57 | Monomer and dimer (<10%) |
| BMS3h-106 | | Monomer |
| BMS3h-107 | 63 | Monomer |
| BMS3h-129 | 59 | Monomer |
| BMS3h-193 | 56 | Monomer |
| BMS3h-197 | 62 & 53 | Monomer and dimer (<5%) |
| BMS3h-198 | 61 | Monomer |
| BMS3h-202 | 60 | Monomer and monomer-dimer equilibrium (<2%) |
| BMS3h-207 | | Dimer and tetramer |
| BMS3h-208 | | Monomer and dimer |
| BMS3h-217 | 57 | Dimer |
| BMS3h-233 | | Monomer |
| BMS3h-242 | | Monomer and monomer-dimer |
| BMS3h-262 | | Monomer |
| BMS3h-265 | | Dimer |
| BMS3h-271 | | Dimer |
| BMS3h-285 | | Monomer |

TABLE 11

Error-Prone-Matured Clones:

| Clone | DSC Tm/° C. | SEC-MALS solution state |
|---|---|---|
| BMS3h-37-1 | 57.2 | |
| BMS3h-37-2 | 56.2 | |
| BMS3h-37-9 | 59.7 | |
| BMS3h-37-11 | 60.0 | |
| BMS3h-56-1 | 49.6 | Monomer |
| BMS3h-56-2 | 63.0 | Monomer and dimer (<2%) |
| BMS3h-56-3 | 64.0 | Monomer (>98%) |
| BMS3h-56-5 | 51.2 | |
| BMS3h-41-1 | 56 | Monomer (~99%) |
| BMS3h-41-2 | 53.4 | |
| BMS3h-41-3 | 51.8 | |
| BMS3h-41-9 | 61 | Monomer and Monomer/Dimer rapid equilibrium (<2%) |
| BMS3h-41-12 | 49.8 | Monomer/Dimer |
| BMS3h-41-13 | | Monomer/Dimer |
| BMS3h-43-1 | 53 | Monomer (~99%) |
| BMS3h-43-3 | 51.2 | |
| BMS3h-43-5 | 48.2 | Monomer/Dimer |
| BMS3h-43-10 | 51.8 | |
| BMS3h-43-11 | 54.8 | |
| BMS3h-43-12 | | Dimer (60%) and Monomer (40%) |
| BMS3h-56-1 | 59.2 | Monomer/Dimer |
| BMS3h-56-2 | 60.1 | Monomer/Dimer |
| BMS3h-56-5 | 57 | Monomer (>95%) |
| BMS3h-56-6 | 57.5 | Monomer/Dimer |
| BMS3h-56-7 | 61 | Monomer + Monomer/Dimer rapid equilibrium (<5%) |
| BMS3h-56-8 | 58 | Monomer (>98%) |
| BMS3h-56-9 | 61 | Monomer + dimer (<5%) |
| BMS3h-56-14 | 60.1 | Monomer |
| BMS3h-193-8 | 60 | |
| BMS3h-193-12 | 52 | |
| BMS3h-193-16 | 54.5 & 65.7 | Monomer |
| BMS3h-193-19 | 56.8 | Monomer |
| BMS3h-193-25 | 55.8 | Monomer |
| BMS3h-193-29 | 60 | Monomer |
| BMS3h-193-30 | 58 | |
| BMS3h-198-1 | 52.5 | Monomer |
| BMS3h-198-2 | | Monomer |
| BMS3h-198-3 | 59 | |
| BMS3h-198-5 | 55.6 | |
| BMS3h-198-19 | 60.7 | |
| BMS3h-198-24 | 59.9 | Monomer |
| BMS3h-198-28 | 60.3 | Monomer |
| BMS3h-202-1 | 56.8 | Monomer |
| BMS3h-202-5 | 55.5 | Trimer (60%) and Monomer/Dimer (40%) |

TABLE 11-continued

Error-Prone-Matured Clones:

| Clone | DSC Tm/° C. | SEC-MALS solution state |
|---|---|---|
| BMS3h-202-10 | 58.3 | Trimer (60%) and Monomer/Dimer (40%) |
| BMS3h-217-1 | | Monomer/Dimer |
| BMS3h-217-2 | | Dimer |
| BMS3h-217-3 | | Dimer |
| BMS3h-217-4 | | Monomer/Dimer |
| BMS3h-217-5 | | Dimer |
| BMS3h-217-6 | | Dimer |
| BMS3h-217-8 | | Dimer |
| BMS3h-217-14 | | Monomer/Dimer |
| BMS3h-217-15 | | Dimer |
| BMS3h-217-16 | | Dimer |
| BMS3h-217-17 | | Monomer/Dimer |
| BMS3h-217-23 | | Dimer |

TABLE 12

Further-Matured Clones:

| Clone | DSC Tm/° C. | SEC-MALS solution state |
|---|---|---|
| BMS3h-37-206 | | Monomer (73%) and dimer (20%) + HMW |
| BMS3h-37-212 | | Dimer |
| BMS3h-38-201 | | Monomer (75%) and Dimer (15%) |
| BMS3h-38-228 | | Monomer (90%) and Trimer (10%) |
| BMS3h-38-231 | | Monomer (90%) and Dimer (10%) |
| BMS3h-38-235 | | Monomer (90%) and Trimer-Dimer |
| BMS3h-38-237 | | Monomer (90%) and Tetramer (10%) |
| BMS3h-38-238 | | Monomer (95%) and Dimer-Monomer |
| BMS3h-56-201 | 57.4 + 61.8 | Monomer and Dimer (15%) |
| BMS3h-56-202 | | Monomer |
| BMS3h-56-203 | | Monomer and Trimer |
| BMS3h-56-206 | | Monomer |
| BMS3h-56-215 | | Monomer, Dimer (2%) and Trimer (9%) |
| BMS3h-56-217 | 52.8 + 54.6 | |
| BMS3h-56-232 | 51.0 + 56.1 | Monomer (95%) and Dimer (5%) |
| BMS3h-56-239 | 53.5 | Monomer |
| BMS3h-56-243 | 51.9 | Monomer and Pentamer |
| BMS3h-56-244 | | Monomer (90%) and Trimer (10%) |
| BMS3h-56-248 | | Monomer (60%), Dimer and Tetramer |
| BMS3h-56-253 | | Monomer |
| BMS3h-56-258 | 62.5 + 57.5 | |
| BMS3h-56-261 | 58.6 + 61.5 | |
| BMS3h-56-266 | 61.3 + 62.3 | |
| BMS3h-56-269 | 64.5 + 67.2 | |

Example 5

Competition Analysis

A BIAcore™ 3000 instrument (GE Healthcare) was used to analyze whether CD40-specific dAbs bound the same CD40 epitope. Approximately 600 response units (RU) of biotinylated human CD40 (BMS) were immobilized on one flow-cell of a streptavidin (SA) BIAcore™ chip. A second flow-cell without any ligand immobilized served as a reference flow-cell for inline referencing. An appropriate dilution of each dAb or Fab to be analyzed was prepared in HBS-EP buffer (0.01 M HEPES pH 7.4 with 0.15 M NaCl, 3 mM EDTA and 0.005% v/v Surfactant P20, GE Healthcare). The dilution chosen was one which when injected as described below resulted in >80% of the maximum possible bound RU for the particular inhibitor, typically 1-10 µM. Next, a mixture of the same dAb or Fab as above (at the same final concentration) was prepared with a second dAb or Fab to be analyzed for competition. The COINJECT function of the instrument was used to inject 60 µl of the single-inhibitor dilution across the CD40-immobilized and reference flow-cells in series, followed immediately by a 60 µl injection of the two-inhibitor mixture. Inline subtraction of the signal from the reference cell was performed by the instrument's control software. The experiment was performed at 25° C. and a flow rate of 30 µl/min of HBS-EP. After each co-injection had been completed, the inhibitors were allowed to dissociate from the ligand in buffer for 60 s before regeneration with a 10 µl injection of 10 mM glycine pH 2.0. The maximum RU obtained for the second injection (the mixture of the two inhibitors) was noted and expressed as a percentage of the RU obtained for the same inhibitor when injected alone.

If the second inhibitor retained at least 100% of the RU usually bound when it was injected alone, then this implied that the two inhibitors bind to discrete epitopes. If less than 100% binding of the second inhibitor was observed, then this was indicative of competition between the two inhibitors for binding to CD40. There are several possible reasons for this competition: the two inhibitors may bind to the same or overlapping epitopes, there may be steric inhibition of binding, or binding of the first inhibitor may induce a conformational change in the antigen that prevents or reduces binding of the second inhibitor.

An example clone from each lineage (except BMS3h-217) was tested for competition with other dAbs in overlapping groups. All the dAbs tested appear to compete with each other for binding to CD40, as shown in TABLES 13 and 14. This data suggests that all antibody polypeptides selected from the group consisting of lineage BMS3h-37, BMS3h-38, BMS3h-41, BMS3h-43, BMS3h-56, BMS3h-131, BMS3h-198, and BMS3h-202 should compete with the binding of a dAb from any of these lineages to human CD40.

TABLE 13

Competition BIAcore ™:

| | | Second Injection (% of single dAb RU) | | | | |
|---|---|---|---|---|---|---|
| First injection | RU first dAb alone | BMS3h-56-5 | BMS3h-37-11 | BMS3h-131-2 | BMS3h-198-1 | BMS3h-202-11 |
| BMS3h-56-5 | 245 | | −15 | 17 | 0.6 | 7.3 |
| BMS3h-37-11 | 158 | 15 | | 25 | 16 | 0.3 |
| BMS3h-131-2 | 220 | 22 | −3.7 | | 23.2 | 10.3 |

TABLE 13-continued

Competition BIAcore ™:

| First injection | RU first dAb alone | Second Injection (% of single dAb RU) | | | | |
|---|---|---|---|---|---|---|
| | | BMS3h-56-5 | BMS3h-37-11 | BMS3h-131-2 | BMS3h-198-1 | BMS3h-202-11 |
| BMS3h-198-1 | 176 | 28 | 6.4 | 41 | | 18 |
| BMS3h-202-11 | 124 | 50 | 42 | 57 | 39 | |

TABLE 14

| First injection | RU first dAb alone | Second Injection (% of single dAb RU) | | | |
|---|---|---|---|---|---|
| | | BMS3h-38-2 | BMS3h-41-9 | BMS3h-43-1 | BMS3h-56-5 |
| BMS3h-38-2 | 170 | | 11 | 29 | 29 |
| BMS3h-41-9 | 150 | 27 | | 44 | 47 |
| BMS3h-43-1 | 210 | 20 | 19 | | 39 |
| BMS3h-56-5 | 190 | 4 | 0 | 22 | |

Similarly, various dAbs were tested for competition with Chi220 Fab', as shown in TABLES 15 and 16. In this case, all the dAbs do not compete with Chi220 Fab', except BMS3h-217, which shows competition. BMS3h-56-5 and BMS3h-193-12 dAbs bound with at least 100% of single dAb RU in the presence of bound Chi220 or G28-5 Fab', suggesting that the Fab' s bind a different epitope(s) than the dAbs. Chi220 Fab' showed a reduction of bound RU in the presence G28-5. The same result was observed in the opposite order of binding. This suggests that G28-5 Fab' binds the same epitope as Chi220 Fab'.

TABLE 15

| First injection | RU first dAb/Fab alone | Second Injection (% of single dAb/Fab RU) | | | |
|---|---|---|---|---|---|
| | | BMS3h-56-5 | Chi220 Fab | G28-5 Fab | BMS3h-193-12 |
| BMS3h-56-5 | 193 | | 98 | 94 | 64 |
| Chi220 Fab | 1089 | 105 | | 11 | 109 |
| G28-5 Fab | 730 | 125 | 39 | | 116 |
| BMS3h-193-12 | 282 | 44 | 98 | 93 | |

TABLE 16

| Clone name | μM dAb or Fab tested | Single dAb RU | % of single dAb RU (Chi220 + dAb) |
|---|---|---|---|
| BMS3h-38-2 | 5 | 156 | 121 |
| BMS3h-41-13 | 5 | 162 | 109 |
| BMS3h-43-3 | 5 | 300 | 101 |
| BMS3h-38-2 | 5 | 175 | 114 |
| BMS3h-56-5 | 5 | 193 | 105 |
| BMS3h-106 | 10 | 165 | 111 |
| BMS3h-107 | 10 | 35 | 146 |
| BMS3h-129 | 10 | 156 | 121 |
| BMS3h-193-12 | 5 | 282 | 98 |
| BMS3h-197 | 1 | 177 | 116 |
| BMS3h-217 | 10 | 85 | 25 |
| G28-5 Fab | 1 | 730 | 11 |

Example 6

CD40 Activity Assays

Anti-human CD40 dAbs were assayed functionally for their ability to antagonize CD40 activities. The CD40 activities tested were B cell proliferation and cytokine production by hCD40L-driven activation of primary human monocyte-derived dendritic cells (DCs). Unless otherwise noted, all assays were performed in RPMI media supplemented with 10% fetal calf serum (FCS). The results using the various assays are shown in TABLE 17.

Soluble IZ-hCD40L-Driven Primary Human B Cell Proliferation:

$1 \times 10^5$ tonsillar human B cells were incubated with 0.6 μg/ml of IZ-hCD40L along with varying titrations of antibody polypeptide in a final volume of 200 μl/well in a 96-well round bottom plate. The plates were incubated at 37° C. for 72 hours, then thymidine ($^3$H; 0.5 μci/well) was added for 6 hours. B cell proliferation was quantified based on thymidine incorporation.

CHO-hCD40L-Driven Primary Human B Cell Proliferation:

CHO cells were transfected with human CD40L to generate a stable cell line expressing high levels of CD40L on the cell surface. CHO-CD40L cells were irradiated at 10,000 Rads before incubation with human B cells. $1 \times 10^5$ tonsillar human B cells were incubated with $1 \times 10^3$ CHO-CD40L cells (1:100 ratio of CHO-CD40L: human B cells) along with varying titrations of antibody polypeptide in a final volume of 200 μl/well in a 96-well round bottom plate. The plates were incubated at 37° C. for 72 hours following which $^3$H-thymidine (0.5 μci/well) was added for 6 hours. B cell proliferation was quantified based on thymidine incorporation.

Soluble IZ-hCD40L-Driven Cyno Splenic Human B Cell Proliferation:

$1 \times 10^5$ cyno splenic B cells were incubated with 0.5 μg/ml of IZ-hCD40L along with varying titrations of antibody polypeptide in a final volume of 200 μl/well in a 96-well round bottom plate. The plates were incubated at 37° C. for 72 hours following which $^3$H-thymidine (0.5 μci/well) was added for 6 hours. B cell proliferation was quantified based on thymidine incorporation.

Primary T Cell-Driven Human B Cell Proliferation:

T cells were isolated from human peripheral blood mononuclear cells (PBMC) and enriched using sheep red blood cell (SRBC) rosetting. Human tonsillar B cells were isolated by homogenizing tonsil tissue to a single-cell suspension. Leukocytes were obtained by ficoll separation, then B cells were negatively selected busing SRBC resetting and enriched by discarding the rosetted cells.

Enriched human T cells were cultured with PM-LCLs (an EBV-transformed B cell line; irradiated at 10,000 Rads) at a 5:1 ratio (T:LCL) for 6 days at 37° C. to generate a population of allogeneic T cells. At day 6, the expanded T cells were isolated and irradiated at 3000 Rads, and then cultured (5×10⁴ T cells/well) with primary human tonsillar B cells (1×10⁵ B cells/well) at a 1:2 ratio in 96-well flat bottom plated coated with anti-CD3 mAb (OKT3). Varying titrations of antibody polypeptides were added to each well; the final volume in each well was 200 µl. Test plates were incubated at 37° C. for 3 days. Human B cell proliferation was determined via the addition of ³H-thymidine (0.5 µci/well) to the cultures for the last 18 hours.

CHO-hCD40L-Driven Activation of Primary Human Monocyte-Derived Dendritic Cells (DCs):

Human PBMCs were enriched for monocytes by depleting T cells via SRBC rosetting. The monocyte-enriched PBMCs were cultured with 10 ng/ml GM-CSF and 5 ng/ml IL-4 in 6-well plates for 6 days at 37° C. The cultured plates were replenished with fresh media (with GM-CSF and IL-4) on days 2 and 5. The immature dendritic cells (DCs) were used in cell assays on day 6. 8×10⁴ immature DCs were cultured with 4×10³ CHO-hCD40L cells (irradiated at 10,000 Rads) along with varying titrations of antibody polypeptides in a 96-well flat bottom plate. After 24 hours, supernatants were harvested and tested for the presence of various cytokines (IL-12, TNF, IL-23). DC activation was determined by the levels of cytokine production.

TABLE 17

| Clone | hIZCD40L-driven Human B Cell Proliferation EC50 (nM) | hIZCD40L-driven Cyno B Cell Proliferation EC50 (nM) | CHO-hCD40L-driven Human B Cell Proliferation EC50 (nM) | T-B cell MLR EC50 (nM) | CHO-hCD40L-driven DC Activation IL-12 EC50 (nM) |
|---|---|---|---|---|---|
| 3h-5 | >7000 | | >7000 | | |
| 3h-8 | >7000 | | >7000 | | |
| 3h-28 | >7000 | | >7000 | | |
| 3h-33 | >7000 | | >7000 | | |
| 3h-48 | >7000 | | >7000 | | |
| 3h-52 | >7000 | | >7000 | | |
| 3h-57 | >7000 | | >7000 | | |
| 3h-61 | >7000 | | >7000 | | |
| 3h-88 | >7000 | | | | |
| 3h-102 | >7000 | | | | |
| 3h-106 | 437.0 ± 214.0 | >7000 | | | |
| 3h-107 | >7000 | >7000 | | | |
| 3h-112 | >7000 | | | | |
| 3h-129 | 2100.0 ± 1000.0 | | | | |
| 3h-197 | 360.0 ± 500.0 | >7000 | | | |
| 3h-207 | >7000 | | | | |
| 3h-208 | >7000 | | | | |
| 3h-37 | 3400.0 ± 2900.0 | >7000 | | | |
| 3h-37-1 | 250.0 ± 100.0 | | | | |
| 3h-37-2 | 5.0 ± 2.0 | >7000 | | 198 ± 35 | 13.0 ± 7.3 |
| 3h-37-202 | 0.6 ± 0.2 | | | 83 ± 18 | 10.0 |
| 3h-37-205 | 2.0 ± 1.0 | | | | 6.6 |
| 3h-37-206 | 5.0 ± 0.8 | | | | 23.0 |
| 3h-37-207 | 4.0 ± 2.0 | | | | 15.5 ± 8.0 |
| 3h-37-212 | 1.0 ± 0.05 | | | | |
| 3h-37-213 | 0.7 ± 0.2 | | | | |
| 3h-37-11 | 8.0 ± 7.0 | | | | |
| 3h-38 | 2800.0 ± 400.0 | >7000 | | | |
| 3h-38-1 | 142.0 ± 86.0 | | | | |
| 3h-38-2 | 10.0 ± 6.0 | >7000 | 723.0 ± 185.0 | 986 ± 383 | 289.0 ± 315.0 |
| 3h-38-201 | >70.0 | | >7000 | | >800.0 |
| 3h-38-205 | 4.0 ± 2.0 | | 1100.0 ± 141.0 | | 29.0 |
| 3h-38-211 | 2.0 ± 1.0 | | 82.0 ± 4.0 | 200 ± 1 | 18.0 ± 19.0 |
| 3h-38-215 | 1.0 ± 0.0 | | 65.0 ± 1.0 | 163 ± 14 | 6.0 ± 4.0 |
| 3h-38-217 | 0.8 ± 0.2 | | 34.0 ± 6.0 | 74 ± 22 | 1.7 ± 0.4 |
| 3h-38-219 | 2.0 ± 0.5 | | 93.0 ± 26.0 | 164 ± 3 | 9.0 ± 5.0 |
| 3h-38-228 | 0.7 ± 0.05 | | | | |
| 3h-38-231 | 0.66 ± 0.2 | | | | |
| 3h-38-235 | 0.4 ± 0.2 | | | | |
| 3h-38-237 | 0.4 ± 0.2 | | | | |
| 3h-38-238 | 0.7 ± 0.03 | | | | |
| 3h-38-3 | 10.0 ± 7.0 | | | | |
| 3h-41 | >7000 | | | | |
| 3h-41-1 | 104.0 ± 56.0 | | | | |
| 3h-41-2 | 47.0 ± 67.0 | | | | |
| 3h-41-3 | 12.0 ± 7.0 | >7000 | | | |
| 3h-41-9 | 148.0 ± 98.0 | | | | |
| 3h-41-12 | 104.0 ± 50.0 | | | | |
| 3h-41-13 | 208.0 ± 90.0 | | | | |
| 3h-43 | 83.0 ± 40.0 | >7000 | | | |
| 3h-43-1 | 53.0 ± 20.0 | | | | |
| 3h-43-3 | 87.0 ± 19.0 | | | | |
| 3h-43-5 | 180.0 ± 130.0 | | | | |
| 3h-43-10 | 143.0 ± 131.0 | | | | |
| 3h-43-11 | 30.0 ± 19.0 | | | | |
| 3h-43-12 | 12.0 ± 6.0 | | | | |

TABLE 17-continued

| Clone | hIZCD40L-driven Human B Cell Proliferation EC50 (nM) | hIZCD40L-driven Cyno B Cell Proliferation EC50 (nM) | CHO-hCD40L-driven Human B Cell Proliferation EC50 (nM) | T-B cell MLR EC50 (nM) | CHO-hCD40L-driven DC Activation IL-12 EC50 (nM) |
|---|---|---|---|---|---|
| 3h-56 | 713.0 ± 133.0 | >7000 | | | |
| 3h-56-1 | 7.0 ± 5.0 | | | | |
| 3h-56-2 | 3.0 ± 1.0 | | 326.0 ± 79.0 | 276 ± 29 | 444.0, >2000.0 |
| 3h-56-201 | 0.12 ± 0.04 | | 11.0 ± 6.0 | 7.25 ± 0.96 | 0.93 ± 0.7 |
| 3h-56-202 | 0.6 ± 0.2 | | 39.0 ± 16.0 | 50 ± 9.8 | 2.9 ± 2.6 |
| 3h-56-203 | 0.45 ± 0.1 | | 51.0 ± 29.0 | 52 ± 23 | 3.7 ± 4.0 |
| 3h-56-206 | 0.1 ± 0.01 | | 6.0 ± 2.0 | 5.25 ± 0.5 | 0.7 ± 0.4 |
| 3h-56-215 | 0.2 ± 0.03 | | 41.0 ± 15.0 | 31 ± 7 | 11.0 ± 12.0 |
| 3h-56-217 | 0.1 ± 0.04 | | 13.0 ± 5.0 | 16 ± 6.7 | 9.4 ± 8.0 |
| 3h-56-224 | 0.5 ± 0.2 | | 26.0 ± 5.0 | 47 ± 11 | 18.0 ± 22.0 |
| 3h-56-232 | 0.27 ± 0.1 | | 37.0 ± 0.7 | 42 ± 10 | 7.3 ± 6.6 |
| 3h-56-239 | 0.11 ± 0.0 | | 18.0 ± 4.0 | 13.5 ± 4.76 | 5.8 ± 6.5 |
| 3h-56-243 | 0.15 ± 0.007 | | 13.5 ± 5.0 | 14.2 ± 4.6 | 8.8 ± 10.0 |
| 3h-56-244 | 0.17 ± 0.02 | | 26.0 ± 3.0 | 21 ± 4.1 | 12.6 ± 16.0 |
| 3h-56-246 | 0.24 ± 0.06 | | 34.0 ± 14.0 | 23.8 ± 6.2 | 23.2 ± 22.0 |
| 3h-56-248 | 0.36 ± 0.1 | | | | |
| 3h-56-253 | 0.4 ± 0.2 | | | | |
| 3h-56-258 | 0.079 ± 0.003 | | 11.0 ± 3.0 | 8.7 ± 1.9 | 1.52 ± 1.6 |
| 3h-56-261 | 0.17 ± 0.09 | | 25.5 ± 6.0 | 17 ± 5.4 | 3.0 ± 1.8 |
| 3h-56-262 | 0.31 ± 0.007 | | | | |
| 3h-56-265 | 0.36 ± 0.06 | | | | |
| 3h-56-266 | 0.19 ± 0.04 | | 19.5 ± 6.0 | 13.8 ± 2.4 | 2.8 ± 2.3 |
| 3h-56-269 | 0.14 ± 0.02 | | 15.0 ± 5.0 | 9.7 ± 1.9 | 1.8 ± 1.2 |
| 3h-56-270 | 0.31 ± 0.1 | | | | |
| 3h-56-5 | 6.0 ± 4.0 | >7000 | | | |
| 3h-56-6 | 4.0 ± 3.0 | | | | |
| 3h-56-7 | 8.0 ± 6.0 | | | | |
| 3h-56-8 | 5.0 ± 2.0 | | | | |
| 3h-56-9 | 3.0 ± 0.6 | | | | |
| 3h-56-15 | 2.0 ± 0.9 | | | | |
| 3h-56-19 | 3.0 ± 2.0 | | | | |
| 3h-56-21 | 2.0 ± 1.0 | | | | |
| 3h-131 | 2700.0 ± 1000.0 | >7000 | | | |
| 3h-131-2 | 55.0 ± 53.0 | >7000 | | | |
| 3h-131-6 | 141.0 ± 37.0 | | | | |
| 3h-131-14 | 24.0 ± 4.0 | | | | |
| 3h-193 | >7000 | | | | |
| 3h-193-12 | 277.0 ± 167.0 | | | | |
| 3h-193-16 | 387.0 ± 173.0 | | | | |
| 3h-193-19 | 233.0 ± 110.0 | | | | |
| 3h-193-25 | 303.0 ± 214.0 | 2200.0 ± 1200.0 | | | |
| 3h-193-29 | 1380.0 ± 721.0 | | | | |
| 3h-198 | 554.0 ± 186.0 | >7000 | | | |
| 3h-198-1 | 64.0 ± 47.0 | | | | |
| 3h-198-2 | 207.0 ± 158.0 | | | | |
| 3h-198-5 | 9.0 ± 6.0 | | | | |
| 3h-198-19 | 19.0 ± 14.0 | | | | |
| 3h-198-24 | 34.0 ± 37.0 | | | | |
| 3h-198-28 | 20.0 ± 9.0 | | | | |
| 3h-202 | 6400.0 ± 1300.0 | >7000 | | | |
| 3h-202-1 | 192.0 ± 77.0 | >7000 | | | |
| 3h-202-5 | 6500.0 ± 1000.0 | | | | |
| 3h-202-10 | 289.0 ± 158.0 | | | | |
| 3h-202-11 | 201.0 ± 103.0 | | | | |
| 3h-217 | 3200.0 ± 2030.0 | >7000, 5300, 1690 | | | |
| 3h-217-1 | 45.0 ± 26.0 | 35.0 ± 8.0 | | | |
| 3h-217-2 | 8.0 ± 4.0 | 7.0 | | | 335.0 |
| 3h-217-4 | 61.0 ± 20.0 | 27.0 | | | |
| 3h-217-5 | 13.0 ± 5.0 | 15.0 | | | |
| 3h-217-6 | 11.0 ± 3.0 | 10.0 | | | |
| 3h-217-7 | 220.0 ± 20.0 | | | | |
| 3h-217-8 | 33.0 ± 10.0 | 14.0 | | | |
| 3h-217-9 | 380.0 ± 170.0 | | | | |
| 3h-217-14 | 26.0 ± 10.0 | 8.0 | | | |
| 3h-217-15 | 47.0 ± 21.0 | 20.0 | | | |
| 3h-217-16 | 5.0 ± 2.0 | 7.0 | | | 1125.0 |
| 3h-217-17 | 1950.0 ± 110.0 | | | | |
| 3h-217-23 | 16.0 ± 6.0 | 15.0 | | | |
| 3h-217-2305 | 11.0 ± 4.0 | | | | |
| 3h-217-30 | 80.0 ± 9.0 | | | | >7700 |
| 3h-217-31 | >700.0 | | | | |

TABLE 17-continued

| Clone | hIZCD40L-driven Human B Cell Proliferation EC50 (nM) | hIZCD40L-driven Cyno B Cell Proliferation EC50 (nM) | CHO-hCD40L-driven Human B Cell Proliferation EC50 (nM) | T-B cell MLR EC50 (nM) | CHO-hCD40L-driven DC Activation IL-12 EC50 (nM) |
|---|---|---|---|---|---|
| 3h-231 | 328.0 ± 144.0 | >7000 | | | |
| 3h-233 | 184.0 ± 75.0 | >7000 | | | 1492.0, >2000 |
| 3h-240 | >7000 | >7000 | | | |
| 3h-242 | 219.0 ± 53.0 | 435.0 ± 62.0 | | | 2050.0 |
| 3h-257 | 135.0 ± 28.0 | >7000 | | | 704.0 ± 445.0 |
| 3h-262 | 548.0 ± 121.0 | >700 | | | 998.0 |
| 3h-263 | >700.0 | >700 | | | |
| 3h-264 | 1200.0 ± 400.0 | >7000 | | | >2000 |
| 3h-265 | 2400.0 ± 1000.0 | >7000 | | | >2000 |
| 3h-271 | 295.0 ± 92.0 | 446.0 | | | >2000 |
| 3h-274 | 1200, >7000 | >7000 | | | |
| 3h-275 | 157.0 ± 11.0 | >7000 | | | |
| 3h-285 | 49.0 ± 0.7 | 155.0 | | | |
| 3h-287 | 287.0 ± 156.0 | 918.0 | | | |
| 3h-289 | 2300.0 ± 1200.0 | 4300.0 | | | |
| 3h-290 | >7000 | 5650.0 | | | |
| 3h-294 | >7000 | >7000 | | | |
| 3h-295 | >7000 | >7000 | | | |
| 3h-296 | 306.0 ± 55.0 | >7000 | | | |
| 3h-309 | 648.0 ± 268.0 | 838.0 | | | |
| 3h-312 | 1100.0 ± 346.0 | >7000 | | | |

Example 7

Dual Specific dAbs Binding CD40 and Serum Albumin

Dual specific dAbs that specifically bind CD40 and human serum albumin (HSA) or cynomolgus serum albumin (CSA) were constructed and tested for activity in cell-based assays. The albumin-specific dAbs are called "AlbudAbs." In this example, AlbudAb fusions comprise a BMS3h dAb that binds CD40 and another domain antibody, DOM7h, that recognizes HSA. The two dAbs are fused in frame to the amino and carboxyl termini of an amino acid linker to form an inline fusion (ILF) polypeptide. The ILF polypeptide is expressed recombinantly as a single fusion protein. RBAs demonstrating activity of the AlbudAb ILFs are described below, and the results are shown in TABLE 18. TABLE 19 summarizes the linker sequences used in the tested AlbudAb ILFs. Kinetic binding data determined by a BIAcore™ assay are shown in TABLE 20.

Human CD40 CHO Cell ELISA for the Detection of dAbs in a Supernatant:

Stably transfected human CD40 expressing CHO-DG44 cells or native CHO-DG44 cells (both BMS) were detached from cell culture flasks using 0.25% trypsin EDTA, and 100,000 cells per well were seeded in growth media into 96 well tissue culture treated plates (NUNC). The cells were allowed to adhere overnight in a humidified atmosphere at 37° C., 5% $CO_2$. On the day of assay, the cell sheet was washed with PBS prior to being fixed with 2% paraformaldehyde (Sigma-Aldrich) for 20 minutes. Following fixing, the cell sheet was washed again in PBS prior to a 1 hr blocking step with 15% fetal bovine serum (FBS, PAA) in PBS. Plates were washed once more prior to addition of 100 µl/well of dAb supernatant and incubated for 2 h at room temperature. Following incubation of dAb supernatants with cells, the plates were washed and dAb binding was detected with incubation of horse radish peroxidase (HRP) conjugate anti-protein A or L, depending on whether dAbs are $V_H$ or $V_L$ domains. Absorbance signal was measured using a SpectraMax M5$^e$ plate reader (Molecular Devices) at 450 nm following neutralization with 1 M HCl.

ICAM-1 Up-Regulation Cell Assay:

Stably transfected human CD40L expressing COS cells were detached from cell culture flasks using Versene (Invitrogen). 20,000 cells per well were seeded into 96 well Highbind, black walled, clear bottom plates (Corning, UK) in assay buffer (RPMI 1640 without phenol red (Sigma-Aldrich, UK)+1% penicillin/streptomycin+10% FBS Gold (both PAA Laboratories, UK). The cells were left to adhere overnight in a humidified atmosphere at 37° C. with 5% $CO_2$. The following day, exhausted assay buffer containing non attached cells was replenished with 100 µl of fresh assay buffer. To this, 20,000 RAMOS cells/well were added in assay buffer in addition to a dilution range of dAb. The assay plate was returned to a humidified atmosphere at 37° C. with 5% $CO_2$ for a further 24 hours. For negative control wells, no RAMOS cells were added. The ability of dAb to inhibit the up-regulation of ICAM-1 on the cell surface of RAMOS cells in response to exposure to CD40L on the cell surface of COS cells was assessed by addition of 0.5 µg/ml mouse anti human ICAM-1 antibody (R&D systems) and 0.2 µg/ml goat anti mouse ALEXA flour 647(Invitrogen, Molecular probes, UK). Following a 3 hour incubation period in the absence of light, relative fluorescence was detected as measured by the AB8200 cellular detection platform (Applied Biosystems).

Analysis of Inline Fusion (ILF) Kinetics of Binding to Serum Albumin:

A BIAcore™ 3000 instrument (GE Healthcare) was used to analyze the binding kinetics of anti-CD40-AlbudAb ILFs to human and cynomolgus serum albumin. Approximately 400 response units (RU) of human serum albumin (HSA) or cynomolgus serum albumin (CSA) were immobilized on a flow-cell of a CM5 BIAcore™ chip using an Amine Coupling Kit (GE Healthcare). A second flow cell without any ligand immobilized served as a reference flow-cell for inline referencing. An appropriate doubling dilution series of each dAb to be analyzed was prepared in HBS-EP buffer (0.01 M HEPES pH 7.4 with 0.15 M NaCl, 3 mM EDTA and 0.005% v/v Surfactant P20, GE Healthcare). Two hundred microliters of each ILF were injected in duplicate using the instrument's KINJECT function. The injections were made across the serum albumin-immobilized and reference flow-cells in series, with inline subtraction of the signal from the reference cell. The experiment was performed at 25° C. and a flow rate of 40 µl/min of HBS-EP. After each injection had been completed, the dAb was allowed to dissociate from the ligand in buffer for 120 s before regeneration with a 10 µl injection of 10 mM glycine pH 2.0. A reference injection of HBS-EP buffer blank (containing no analyte) was also injected under the same conditions to serve as a second reference for subtraction from each analyte trace. BIAevaluation 4.1 software (GE Healthcare) was used to subtract both the reference flow-cell trace and the buffer blank trace from each analyte trace. The same software was used to perform a simultaneous, global fit of a 1:1 (Langmuir) kinetic model to the association and dissociation phases of the analyte dilution series traces. This model yielded association and dissociation rate constants ($k_a$ and $k_d$, respectively) and the equilibrium dissociation constant ($K_D$) of the interaction. The parameter values are shown in TABLE 20.

TABLE 18

Activity Assays

| DMS No. | N-term. dAb | Linker | C-term. dAb | CHO-CD40 Cell RBA $EC_{50}$ (nM) 0.1% BSA | CHO-CD40 Cell RBA $EC_{50}$ (nM) 50 µM HSA | ICAM-1 Cell Assay $EC_{50}$ (nM) 10% bovine serum | ICAM-1 Cell Assay $EC_{50}$ (nM) 10% human serum |
|---|---|---|---|---|---|---|---|
| DMS0654 | BMS3h-56-201 | AST | DOM7h-11-3 | 15 | 8.6 | | |
| DMS0655 | BMS3h-56-201 | AST | DOM7h-11-87 | 6.3 | 2.7 | | |
| DMS0656 | BMS3h-56-258 | AST | DOM7h-11-3 | 11.8 | 26.8 | | |
| DMS0657 | BMS3h-56-258 | AST | DOM7h-11-87 | 6.8 | 16.6 | | |
| DMS0658 | DOM7h-11-3 | TVAAPS | BMS3h-56-201 | 12.2 | 9.1 | | |
| DMS0659 | DOM7h-11-87 | TVAAPS | BMS3h-56-201 | 7.2 | 3.3 | | |
| DMS0660 | DOM7h-11-3 | TVAAPS | BMS3h-56-258 | 21.8 | 13.1 | | |
| DMS0661 | DOM7h-11-87 | TVAAPS | BMS3h-56-258 | 4.1 | 5.7 | | |
| DMS0662 | DOM7h-11-90 | TVAAPS | BMS3h-56-201 | | | 33.5 | >1000 |
| DMS0663 | DOM7h-11-86 | TVAAPS | BMS3h-56-201 | | | 21.4 | >1000 |
| DMS0664 | DOM7h-11-69 | TVAAPS | BMS3h-56-201 | | | 16.5 | >1000 |
| DMS0677 | DOM7h-11-90 | TVA | BMS3h-56-258 | | | 21.7 | 20.35 |
| DMS0679 | DOM7h-11-90 | $G_4S$ | BMS3h-56-258 | | | 21.7 | 39.2 |
| DMS0680 | DOM7h-11-90 | $(G_4S)_3$ | BMS3h-56-258 | | | 39.3 | 74.2 |
| DMS0681 | DOM7h-11-90 | $(G_4S)_5$ | BMS3h-56-258 | | | 43.6 | 53.3 |
| DMS0682 | BMS3h-56-258 | TVA | DOM7h-11-90 | | | 10.2 | 94.8 |
| DMS0683 | BMS3h-56-258 | ASTSGPS | DOM7h-11-90 | | | 32.4 | 50.9 |
| DMS0684 | BMS3h-56-258 | $G_4S$ | DOM7h-11-90 | | | 37.9 | 74.3 |
| DMS0685 | BMS3h-56-258 | $(G_4S)_3$ | DOM7h-11-90 | | | 31.9 | 62.4 |
| DMS0686 | BMS3h-56-258 | $(G_4S)_5$ | DOM7h-11-90 | | | 48.3 | 66.6 |

TABLE 19

Representative Linker Sequences

| AST | SEQ ID NO: 5 |
|---|---|
| TVAAPS | SEQ ID NO: 6 |
| TVA | SEQ ID NO: 7 |
| GGGGS | SEQ ID NO: 1207 |
| (GGGGS)$_3$ | SEQ ID NO: 1208 |
| (GGGGS)$_5$ | SEQ ID NO: 1209 |
| ASTSGPS | SEQ ID NO: 8 |

TABLE 20

BIAcore ™ Analysis

| DMS No. | N-Term dAb | Linker ("TVAAPS" disclosed as SEQ ID NO: 6) | C-Term dAb | Human Serum Albumin $k_a$ (1/Ms) ×10$^{-6}$ | Human Serum Albumin $k_d$ (1/s) ×10$^3$ | Human Serum Albumin $K_D$ (nM) | Cyno Serum Albumin $k_a$ (1/Ms) ×10$^{-6}$ | Cyno Serum Albumin $k_d$ (1/s) ×10$^3$ | Cyno Serum Albumin $K_D$ (nM) |
|---|---|---|---|---|---|---|---|---|---|
| DMS0659 | DOM7h-11-87 | TVAAPS | BMS3h-56-201 | 0.85, 2.85, 2.6 | 1.17, 1.69, 1.2 | 1.37, 0.60, 0.45 | 0.85, 2.79, 2.9 | 2.37, 3.37, 2.4 | 2.79, 1.21, 0.83 |
| DMS0662 | DOM7h-11-90 | TVAAPS | BMS3h-56-201 | 1.1, 1.19 | 1.33, 1.47 | 1.21, 1.23 | 1.01, 1.10 | 2.52, 2.66 | 2.5, 2.42 |
| DMS0663 | DOM7h-11-86 | TVAAPS | BMS3h-56-201 | 1.25, 1.32 | 1.40, 1.60 | 1.12, 1.21 | 1.18, 1.18 | 2.81, 2.96 | 2.38, 2.52 |
| DMS0664 | DOM7h-11-69 | TVAAPS | BMS3h-56-201 | 2.5, 0.93 | 1.42, 1.49 | 0.57, 1.59 | 2.51, 0.92 | 2.73, 2.72 | 1.09, 2.97 |

TABLE 21 lists amino acid sequences of representative AlbudAb ILFs that can specifically bind CD40 and HSA or CSA. The designation of each ILF identifies the particular linker sequence: "G×S" means the linker has "x" residues of glycine followed by serine, and "(G×S)y" means the linker has y repeating units of G×S. TABLE 22 discloses representative nucleic acids that encode the ILF sequences listed in TABLE 21. As is known in the art, multiple codons can encode the same amino acid. Nucleic acids encoding a protein sequence thus include nucleic acids having codon degeneracy.

TABLE 21

Dual Specificity dAb Amino Acid Sequences
(Table 21 discloses "AST," "TVAAPS," "TVA," "G4S,"
"(G4S)3," "(G4S)5," and "ASTSGPS" disclosed
as SEQ ID NOS 5-7, 1207-1209 and 8, respectively)

DMS0654 BMS3h-56-201-AST-DOM7h-11-3
EVQLLESGGGLVQPGGSLRLSCAASGFTFRDYEMWWVRQAPGKGLERVSAINPQGTRTY
YADSVKGRFTISRDNSKNTLYLQMNSLRAEDTAVYYCAKLPFYFQEWGQGTLVTVSSAS
TDIQMTQSPSSLSASVGDRVTITCRASRPIGTTLSWYQQKPGKAPKLLILWNSRLQSGV
PSRFSGSGSGTDFTLTISSLQPEDFATYYCAQAGTHPTTFGQGTKVEIKR (SEQ ID
NO: 1210)

DMS0655 BMS3h-56-201-AST-DOM7h-11-87
EVQLLESGGGLVQPGGSLRLSCAASGFTFRDYEMWWVRQAPGKGLERVSAINPQGTRTY
YADSVKGRFTISRDNSKNTLYLQMNSLRAEDTAVYYCAKLPFYFQEWGQGTLVTVSSAS
TDIQMTQSPSSLSASVGDRVTITCRASRPIGTMLSWYQQKPGKAPKLLILAFSRLQSGV
PSRFSGSGSGTDFTLTISSLQPEDFATYYCAQAGTHHTTFGQGTKVEIKR (SEQ ID
NO: 1211)

DMS0656 BMS3h-56-258-AST-DOM7h-11-3
EVQLLESGGGLVQPGGSLRLSCAASGFTFRDYEMWWVRQAPGKGLERVSAINPQGTRTY
YADSVKGRFTISRDNSKNTLYLQMNSLRAEDTAVYYCAKLPFYFHEWGQGTLVTVSSAS
TDIQMTQSPSSLSASVGDRVTITCRASRPIGTTLSWYQQKPGKAPKLLILWNSRLQSGV
PSRFSGSGSGTDFTLTISSLQPEDFATYYCAQAGTHPTTFGQGTKVEIKR (SEQ ID
NO: 1212)

DMS0657 BMS3h-56-258-AST-DOM7h-11-87
EVQLLESGGGLVQPGGSLRLSCAASGFTFRDYEMWWVRQAPGKGLERVSAINPQGTRTY
YADSVKGRFTISRDNSKNTLYLQMNSLRAEDTAVYYCAKLPFYFHEWGQGTLVTVSSAS
TDIQMTQSPSSLSASVGDRVTITCRASRPIGTMLSWYQQKPGKAPKLLILAFSRLQSGV
PSRFSGSGSGTDFTLTISSLQPEDFATYYCAQAGTHHTTFGQGTKVEIKR (SEQ ID
NO: 1213)

DMS0658 DOM7h-11-3-TVAAPS-BMS3h-56-201
DIQMTQSPSSLSASVGDRVTITCRASRPIGTTLSWYQQKPGKAPKLLILWNSRLQSGVP
SRFSGSGSGTDFTLTISSLQPEDFATYYCAQAGTHPTTFGQGTKVEIKRTVAAPSEVQL
LESGGGLVQPGGSLRLSCAASGFTFRDYEMWWVRQAPGKGLERVSAINPQGTRTYYADS
VKGRFTISRDNSKNTLYLQMNSLRAEDTAVYYCAKLPFYFQEWGQGTLVTVSS (SEQ
ID NO: 1214)

DMS0659 DOM7h-11-87-TVAAPS-BMS3h-56-201
DIQMTQSPSSLSASVGDRVTITCRASRPIGTMLSWYQQKPGKAPKLLILAFSRLQSGVP
SRFSGSGSGTDFTLTISSLQPEDFATYYCAQAGTHHTTFGQGTKVEIKRTVAAPSEVQL
LESGGGLVQPGGSLRLSCAASGFTFRDYEMWWVRQAPGKGLERVSAINPQGTRTYYADS
VKGRFTISRDNSKNTLYLQMNSLRAEDTAVYYCAKLPFYFQEWGQGTLVTVSS (SEQ
ID NO: 1215)

DMS0660 DOM7h-11-3-TVAAPS-BMS3h-56-258
DIQMTQSPSSLSASVGDRVTITCRASRPIGTTLSWYQQKPGKAPKLLILWNSRLQSGVP
SRFSGSGSGTDFTLTISSLQPEDFATYYCAQAGTHPTTFGQGTKVEIKRTVAAPSEVQL
LESGGGLVQPGGSLRLSCAASGFTFRDYEMWWVRQAPGKGLERVSAINPQGTRTYYADS
VKGRFTISRDNSKNTLYLQMNSLRAEDTAVYYCAKLPFYFHEWGQGTLVTVSS (SEQ
ID NO: 1216)

DMS0661 DOM7h-11-87-TVAAPS-BMS3h-56-258
DIQMTQSPSSLSASVGDRVTITCRASRPIGTMLSWYQQKPGKAPKLLILAFSRLQSGVP
SRFSGSGSGTDFTLTISSLQPEDFATYYCAQAGTHHTTFGQGTKVEIKRTVAAPSEVQL
LESGGGLVQPGGSLRLSCAASGFTFRDYEMWWVRQAPGKGLERVSAINPQGTRTYYADS
VKGRFTISRDNSKNTLYLQMNSLRAEDTAVYYCAKLPFYFHEWGQGTLVTVSS (SEQ
ID NO: 1217)

DMS0662 DOM7h-11-90-TVAAPS-BMS3h-56-201
DIQMTQSPSSLSASVGDRVTITCRASRPIGTMLSWYQQKPGKAPKLLILAFSRLQSGVP
SRFSGSGSGTDFTLTISNLQPEDFATYYCAQAGTHPTTFGQGTKVEIKRTVAAPSEVQL
LESGGGLVQPGGSLRLSCAASGFTFRDYEMWWVRQAPGKGLERVSAINPQGTRTYYADS
VKGRFTISRDNSKNTLYLQMNSLRAEDTAVYYCAKLPFYFQEWGQGTLVTVSS (SEQ
ID NO: 1218)

DMS0663 DOM7h-11-86-TVAAPS-BMS3h-56-201
DIQMTQSPSSLSASVGDRVTITCRASRPIGTMLSWYQQKPGKAPKLLILAFSRLQSGVP
SRFSGSGSGTDFTLTISSLQPEDVATYYCAQAGTHPTTFGQGTKVEIKRTVAAPSEVQL
LESGGGLVQPGGSLRLSCAASGFTFRDYEMWWVRQAPGKGLERVSAINPQGTRTYYADS

TABLE 21-continued

Dual Specificity dAb Amino Acid Sequences
(Table 21 discloses "AST," "TVAAPS," "TVA," "G4S,"
"(G4S)3," "(G4S)5," and "ASTSGPS" disclosed
as SEQ ID NOS 5-7, 1207-1209 and 8, respectively)

VKGRFTISRDNSKNTLYLQMNSLRAEDTAVYYCAKLPFYFQEWGQGTLVTVSS (SEQ
ID NO: 1219)

DMS0664 DOM7h-11-69-TVAAPS-BMS3h-56-201
DIQMTQSPSSLSASVGDRVTITCRASRPIGTMLSWYQQKPGKAPKLLILAFSRLQSGVP
SRFSGSGSGTDFTLTISSLQPEDEATYYCAQAGVHPTTFGQGTKVEIKRTVAAPSEVQL
LESGGGLVQPGGSLRLSCAASGFTERDYEMWWVRQAPGKGLERVSAINPQGTRTYYADS
VKGRFTISRDNSKNTLYLQMNSLRAEDTAVYYCAKLPFYFQEWGQGTLVTVSS (SEQ
ID NO: 1220)

DMS0667 DOM7h-11-3-TVAAPS-BMS3h-38-240
DIQMTQSPSSLSASVGDRVTITCRASRPIGTTLSWYQQKPGKAPKLLILWNSRLQSGVP
SRFSGSGSGTDFTLTISSLQPEDFATYYCAQAGTHPTTFGQGTKVEIKRTVAAPSEVQL
LESGGGLVQPGGSLRLSCAASGFTFEEEEMIWVRQAPGKGLEWVSAISRNGYSTYYADS
VKGRFTISRDNSKNTLYLQMNSLRAEDTAVYYCGKEPFRYDYWGQGTLVTVSS (SEQ
ID NO: 1221)

DMS0668 BMS3h-38-240-AST-DOM7h-11-3
EVQLLESGGGLVQPGGSLRLSCAASGFTFEEEEMIWVRQAPGKGLEWVSAISRNGYSTY
YADSVKGRFTISRDNSKNTLYLQMNSLRAEDTAVYYCGKEPFRYDYWGQGTLVTVSSAS
TDIQMTQSPSSLSASVGDRVTITCRASRPIGTTLSWYQQKPGKAPKLLILWNSRLQSGV
PSRFSGSGSGTDFTLTISSLQPEDFATYYCAQAGTHPTTFGQGTKVEIKR (SEQ ID
NO: 1222)

DMS0669 DOM7h-14-10-TVAAPS-BMS3h-38-240
DIQMTQSPSSLSASVGDRVTITCRASQWIGSQLSWYQQKPGKAPKLLIMWRSSLQSGVP
SRFSGSGSGTDFTLTISSLQPEDFATYYCAQGLRHPKTFGQGTKVEIKRTVAAPSEVQL
LESGGGLVQPGGSLRLSCAASGFTFEEEEMIWVRQAPGKGLEWVSAISRNGYSTYYADS
VKGRFTISRDNSKNTLYLQMNSLRAEDTAVYYCGKEPFRYDYWGQGTLVTVSS (SEQ
ID NO: 1223)

DMS0670 BMS3h-38-240-AST-DOM7h-14-10
EVQLLESGGGLVQPGGSLRLSCAASGFTFEEEEMIWVRQAPGKGLEWVSAISRNGYSTY
YADSVKGRFTISRDNSKNTLYLQMNSLRAEDTAVYYCGKEPFRYDYWGQGTLVTVSSAS
TDIQMTQSPSSLSASVGDRVTITCRASQWIGSQLSWYQQKPGKAPKLLIMWRSSLQSGV
PSRFSGSGSGTDFTLTISSLQPEDFATYYCAQGLRHPKTFGQGTKVEIKR (SEQ ID
NO: 1224)

DMS0671 BMS3h-38-235-AST-DOM7h-11-3
EVQLLASGGGLVQPGGSLRLSCAASGFTFEEEEMIWVRQAPGKGLEWVSAISRNGYSTY
YADSVKGRFTISRDNSKNTLYLQMNSLRAEDTAVYYCGKEPFRYDYWGQGTLVTVSSAS
TDIQMTQSPSSLSASVGDRVTITCRASRPIGTTLSWYQQKPGKAPKLLILWNSRLQSGV
PSRFSGSGSGTDFTLTISSLQPEDFATYYCAQAGTHPTTFGQGTKVEIKR (SEQ ID
NO: 1225)

DMS0672 BMS3h-38-235-AST-DOM7h-11-90
EVQLLASGGGLVQPGGSLRLSCAASGFTFEEEEMIWVRQAPGKGLEWVSAISRNGYSTY
YADSVKGRFTISRDNSKNTLYLQMNSLRAEDTAVYYCGKEPFRYDYWGQGTLVTVSSAS
TDIQMTQSPSSLSASVGDRVTITCRASRPIGTMLSWYQQKPGKAPKLLILAFSRLQSGV
PSRFSGSGSGTDFTLTISNLQPEDFATYYCAQAGTHPTTFGQGTKVEIKR (SEQ ID
NO: 1226)

DMS0674 DOM7h-11-3-TVAAPS-BMS3h-38-235
DIQMTQSPSSLSASVGDRVTITCRASRPIGTTLSWYQQKPGKAPKLLILWNSRLQSGVP
SRFSGSGSGTDFTLTISSLQPEDFATYYCAQAGTHPTTFGQGTKVEIKRTVAAPSEVQL
LASGGGLVQPGGSLRLSCAASGFTFEEEEMIWVRQAPGKGLEWVSAISRNGYSTYYADS
VKGRFTISRDNSKNTLYLQMNSLRAEDTAVYYCGKEPFRYDYWGQGTLVTVSS (SEQ
ID NO: 1227)

DMS0675 DOM7h-11-90-TVAAPS-BMS3h-38-235
DIQMTQSPSSLSASVGDRVTITCRASRPIGTMLSWYQQKPGKAPKLLILAFSRLQSGVP
SRFSGSGSGTDFTLTISNLQPEDFATYYCAQAGTHPTTFGQGTKVEIKRTVAAPSEVQL
LASGGGLVQPGGSLRLSCAASGFTFEEEEMIWVRQAPGKGLEWVSAISRNGYSTYYADS
VKGRFTISRDNSKNTLYLQMNSLRAEDTAVYYCGKEPFRYDYWGQGTLVTVSS (SEQ
ID NO: 1228)

DMS0677 DOM7h-11-90-TVA-BMS3h-56-258
DIQMTQSPSSLSASVGDRVTITCRASRPIGTMLSWYQQKPGKAPKLLILAFSRLQSGVP
SRFSGSGSGTDFTLTISNLQPEDFATYYCAQAGTHPTTFGQGTKVEIKRTVAEVQLLES
GGGLVQPGGSLRLSCAASGFTFRDYEMWWVRQAPGKGLERVSAINPQGTRTYYADSVKG
RFTISRDNSKNTLYLQMNSLRAEDTAVYYCAKLPFYFHEWGQGTLVTVSS (SEQ ID
NO: 1229)

DMS0678 DOM7h-11-90-ASTSGPS-BMS3h-56-258
DIQMTQSPSSLSASVGDRVTITCRASRPIGTMLSWYQQKPGKAPKLLILAFSRLQSGVP

TABLE 21-continued

Dual Specificity dAb Amino Acid Sequences
(Table 21 discloses "AST," "TVAAPS," "TVA," "G4S,"
"(G4S)3," "(G4S)5," and "ASTSGPS" disclosed
as SEQ ID NOS 5-7, 1207-1209 and 8, respectively)

SRFSGSGSGTDFTLTISNLQPEDFATYYCAQAGTHPTTFGQGTKVEIKRASTSGPSEVQ
LLESGGGLVQPGGSLRLSCAASGFTFRDYEMWWVRQAPGKGLERVSAINPQGTRTYYAD
SVKGRFTISRDNSKNTLYLQMNSLRAEDTAVYYCAKLPFYFHEWGQGTLVTVSS (SEQ
ID NO: 1230)

DMS0679 DOM7h-11-90-G4S-BMS3h-56-258
DIQMTQSPSSLSASVGDRVTITCRASRPIGTMLSWYQQKPGKAPKLLILAFSRLQSGVP
SRFSGSGSGTDFTLTISNLQPEDFATYYCAQAGTHPTTFGQGTKVEIKRGGGGSEVQLL
ESGGGLVQPGGSLRLSCAASGFTFRDYEMWWVRQAPGKGLERVSAINPQGTRTYYADSV
KGRFTISRDNSKNTLYLQMNSLRAEDTAVYYCAKLPFYFHEWGQGTLVTVSS (SEQ
ID NO: 1231)

DMS0680 DOM7h-11-90-(G4S)3-BMS3h-56-258
DIQMTQSPSSLSASVGDRVTITCRASRPIGTMLSWYQQKPGKAPKLLILAFSRLQSGVP
SRFSGSGSGTDFTLTISNLQPEDFATYYCAQAGTHPTTFGQGTKVEIKRGGGGSGGGGS
GGGGSEVQLLESGGGLVQPGGSLRLSCAASGFTFRDYEMWWVRQAPGKGLERVSAINPQ
GTRTYYADSVKGRFTISRDNSKNTLYLQMNSLRAEDTAVYYCAKLPFYFHEWGQGTLVT
VSS (SEQ ID NO: 1232)

DMS0681 DOM7h-11-90-(G4S)5-BMS3h-56-258
DIQMTQSPSSLSASVGDRVTITCRASRPIGTMLSWYQQKPGKAPKLLILAFSRLQSGVP
SRFSGSGSGTDFTLTISNLQPEDFATYYCAQAGTHPTTFGQGTKVEIKRGGGGSGGGGS
GGGGSGGGGSGGGGSEVQLLESGGGLVQPGGSLRLSCAASGFTFRDYEMWWVRQAPGKG
LERVSAINPQGTRTYYADSVKGRFTISRDNSKNTLYLQMNSLRAEDTAVYYCAKLPFYF
HEWGQGTLVTVSS (SEQ ID NO: 1233)

DMS0682 BMS3h-56-258-TVA-DOM7h-11-90
EVQLLESGGGLVQPGGSLRLSCAASGFTFRDYEMWWVRQAPGKGLERVSAINPQGTRTY
YADSVKGRFTISRDNSKNTLYLQMNSLRAEDTAVYYCAKLPFYFHEWGQGTLVTVSSTV
ADIQMTQSPSSLSASVGDRVTITCRASRPIGTMLSWYQQKPGKAPKLLILAFSRLQSGV
PSRFSGSGSGTDFTLTISNLQPEDFATYYCAQAGTHPTTFGQGTKVEIKR (SEQ ID
NO: 1234)

DMS0683 BMS3h-56-258-ASTSGPS-DOM7h-11-90
EVQLLESGGGLVQPGGSLRLSCAASGFTFRDYEMWWVRQAPGKGLERVSAINPQGTRTY
YADSVKGRFTISRDNSKNTLYLQMNSLRAEDTAVYYCAKLPFYFHEWGQGTLVTVSSAS
TSGPSDIQMTQSPSSLSASVGDRVTITCRASRPIGTMLSWYQQKPGKAPKLLILAFSRL
QSGVPSRFSGSGSGTDFTLTISNLQPEDFATYYCAQAGTHPTTFGQGTKVEIKR (SEQ
ID NO: 1235)

DMS0684 BMS3h-56-258-G4S-DOM7h-11-90
EVQLLESGGGLVQPGGSLRLSCAASGFTFRDYEMWWVRQAPGKGLERVSAINPQGTRTY
YADSVKGRFTISRDNSKNTLYLQMNSLRAEDTAVYYCAKLPFYFHEWGQGTLVTVSSGG
GGSDIQMTQSPSSLSASVGDRVTITCRASRPIGTMLSWYQQKPGKAPKLLILAFSRLQS
GVPSRFSGSGSGTDFTLTISNLQPEDFATYYCAQAGTHPTTFGQGTKVEIKR (SEQ
ID NO: 1236)

DMS0685 BMS3h-56-258-(G4S)3-DOM7h-11-90
EVQLLESGGGLVQPGGSLRLSCAASGFTFRDYEMWWVRQAPGKGLERVSAINPQGTRTY
YADSVKGRFTISRDNSKNTLYLQMNSLRAEDTAVYYCAKLPFYFHEWGQGTLVTVSSGG
GGSGGGGSGGGGSDIQMTQSPSSLSASVGDRVTITCRASRPIGTMLSWYQQKPGKAPKL
LILAFSRLQSGVPSRFSGSGSGTDFTLTISNLQPEDFATYYCAQAGTHPTTFGQGTKVE
IKR (SEQ ID NO: 1237)

DMS0686 BMS3h-56-258-(G4S)5-DOM7h-11-90
EVQLLESGGGLVQPGGSLRLSCAASGFTFRDYEMWWVRQAPGKGLERVSAINPQGTRTY
YADSVKGRFTISRDNSKNTLYLQMNSLRAEDTAVYYCAKLPFYFHEWGQGTLVTVSSGG
GGSGGGGSGGGGSGGGGSGGGGSDIQMTQSPSSLSASVGDRVTITCRASRPIGTMLSWY
QQKPGKAPKLLILAFSRLQSGVPSRFSGSGSGTDFTLTISNLQPEDFATYYCAQAGTHP
TTFGQGTKVEIKR (SEQ ID NO: 1238)

DMS0688 DOM7h-11-90-TVAAPS-BMS3h-56-258
DIQMTQSPSSLSASVGDRVTITCRASRPIGTMLSWYQQKPGKAPKLLILAFSRLQSGVP
SRFSGSGSGTDFTLTISNLQPEDFATYYCAQAGTHPTTFGQGTKVEIKRTVAAPSEVQL
LESGGGLVQPGGSLRLSCAASGFTFRDYEMWWVRQAPGKGLERVSAINPQGTRTYYADS
VKGRFTISRDNSKNTLYLQMNSLRAEDTAVYYCAKLPFYFHEWGQGTLVTVSS (SEQ
ID NO: 1239)

TABLE 22

Polynucleotides Encoding Dual Specificity dAbs
(Table 22 discloses "AST," "TVAAPS," "TVA," "G4S,"
"(G4S)3," "(G4S)5," and "ASTSGPS" disclosed as
SEQ ID NOS 5-7, 1207-1209 and 8, respectively)

```
DMS0654 BMS3h-56-201-AST-DOM7h-11-3
GAGGTGCAGCTGTTGGAGTCTGGGGGAGGCTTGGTACAGCCTGGGGGGTCCCTGCGTCTC
TCCTGTGCAGCCTCCGGATTCACCTTTCGGGATTATGAGATGTGGTGGGTCCGCCAGGCT
CCAGGGAAGGGTCTAGAGCGGGTCTCAGCTATTAATCCGCAGGGTACGCGTACATACTAC
GCAGACTCCGTGAAGGGCCGGTTCACCATCTCCCGCGACAATTCCAAGAACACGCTGTAT
CTGCAAATGAACAGCCTGCGTGCCGAGGACACCGCGGTATATTACTGTGCGAAACTTCCG
TTTTACTTTCAGGAGTGGGGTCAGGGAACCCTGGTCACCGTCTCGAGCGCTAGCACCGAC
ATCCAGATGACCCAGTCTCCATCCTCCCTGTCTGCATCTGTAGGAGACCGTGTCACCATC
ACTTGCCGGGCAAGTCGTCCGATTGGGACGACGTTAAGTTGGTACCAGCAGAAACCAGGG
AAAGCCCCTAAGCTCCTGATCCTTTGGAATTCCCGTTTGCAAAGTGGGGTCCCATCACGT
TTCAGTGGCAGTGGATCTGGGACAGATTTCACTCTCACCATCAGCAGTCTGCAACCTGAA
GATTTTGCTACGTACTACTGTGCGCAGGCTGGGACGCATCCTACGACGTTCGGCCAAGGG
ACCAAGGTGGAAATCAAACGG (SEQ ID NO: 1240)

DMS0655 BMS3h-56-201-AST-DOM7h-11-87
GAGGTGCAGCTGTTGGAGTCTGGGGGAGGCTTGGTACAGCCTGGGGGGTCCCTGCGTCTC
TCCTGTGCAGCCTCCGGATTCACCTTTCGGGATTATGAGATGTGGTGGGTCCGCCAGGCT
CCAGGGAAGGGTCTAGAGCGGGTCTCAGCTATTAATCCGCAGGGTACGCGTACATACTAC
GCAGACTCCGTGAAGGGCCGGTTCACCATCTCCCGCGACAATTCCAAGAACACGCTGTAT
CTGCAAATGAACAGCCTGCGTGCCGAGGACACCGCGGTATATTACTGTGCGAAACTTCCG
TTTTACTTTCAGGAGTGGGGTCAGGGAACCCTGGTCACCGTCTCGAGCGCTAGCACCGAC
ATCCAGATGACCCAGTCTCCATCCTCCCTGTCTGCATCTGTAGGAGACCGTGTCACCATC
ACTTGCCGGGCAAGTCGTCCGATTGGGACGATGTTAAGTTGGTACCAGCAGAAACCAGGG
AAAGCCCCTAAGCTCCTGATCCTTGCTTTTTCCCGTTTGCAAAGTGGGGTCCCATCACGT
TTCAGTGGCAGTGGATCTGGGACAGATTTCACTCTCACCATCAGCAGTCTGCAACCTGAA
GATTTTGCTACGTACTACTGTGCGCAGGCTGGGACGCATCATACGACGTTCGGCCAAGGG
ACCAAGGTGGAAATCAAACGG (SEQ ID NO: 1241)

DMS0656 BMS3h-56-258-AST-DOM7h-11-3
GAGGTGCAGCTGTTGGAGTCTGGGGGAGGCTTGGTACAGCCTGGGGGGTCCCTGCGTCTC
TCCTGTGCAGCCTCCGGATTCACCTTTCGGGATTATGAGATGTGGTGGGTCCGCCAGGCT
CCAGGGAAGGGTCTAGAGCGGGTCTCAGCTATTAATCCGCAGGGTACGCGTACATACTAC
GCAGACTCCGTGAAGGGCCGGTTCACCATCTCCCGCGACAATTCCAAGAACACGCTGTAT
CTGCAAATGAACAGCCTGCGTGCCGAGGACACCGCGGTATATTACTGTGCGAAACTTCCG
TTTTACTTTCACGAGTGGGGTCAGGGAACCCTGGTCACCGTCTCGAGCGCTAGCACCGAC
ATCCAGATGACCCAGTCTCCATCCTCCCTGTCTGCATCTGTAGGAGACCGTGTCACCATC
ACTTGCCGGGCAAGTCGTCCGATTGGGACGACGTTAAGTTGGTACCAGCAGAAACCAGGG
AAAGCCCCTAAGCTCCTGATCCTTTGGAATTCCCGTTTGCAAAGTGGGGTCCCATCACGT
TTCAGTGGCAGTGGATCTGGGACAGATTTCACTCTCACCATCAGCAGTCTGCAACCTGAA
GATTTTGCTACGTACTACTGTGCGCAGGCTGGGACGCATCCTACGACGTTCGGCCAAGGG
ACCAAGGTGGAAATCAAACGG (SEQ ID NO: 1242)

DMS0657 BMS3h-56-258-AST-DOM7h-11-87
GAGGTGCAGCTGTTGGAGTCTGGGGGAGGCTTGGTACAGCCTGGGGGGTCCCTGCGTCTC
TCCTGTGCAGCCTCCGGATTCACCTTTCGGGATTATGAGATGTGGTGGGTCCGCCAGGCT
CCAGGGAAGGGTCTAGAGCGGGTCTCAGCTATTAATCCGCAGGGTACGCGTACATACTAC
GCAGACTCCGTGAAGGGCCGGTTCACCATCTCCCGCGACAATTCCAAGAACACGCTGTAT
CTGCAAATGAACAGCCTGCGTGCCGAGGACACCGCGGTATATTACTGTGCGAAACTTCCG
TTTTACTTTCACGAGTGGGGTCAGGGAACCCTGGTCACCGTCTCGAGCGCTAGCACCGAC
ATCCAGATGACCCAGTCTCCATCCTCCCTGTCTGCATCTGTAGGAGACCGTGTCACCATC
ACTTGCCGGGCAAGTCGTCCGATTGGGACGATGTTAAGTTGGTACCAGCAGAAACCAGGG
AAAGCCCCTAAGCTCCTGATCCTTGCTTTTTCCCGTTTGCAAAGTGGGGTCCCATCACGT
TTCAGTGGCAGTGGATCTGGGACAGATTTCACTCTCACCATCAGCAGTCTGCAACCTGAA
GATTTTGCTACGTACTACTGTGCGCAGGCTGGGACGCATCATACGACGTTCGGCCAAGGG
ACCAAGGTGGAAATCAAACGG (SEQ ID NO: 1243)

DMS0658 DOM7h-11-3-TVAAPS-BMS3h-56-201
GACATCCAGATGACCCAGTCTCCATCCTCCCTGTCTGCATCTGTAGGAGACCGTGTCACC
ATCACTTGCCGGGCAAGTCGTCCGATTGGGACGACGTTAAGTTGGTACCAGCAGAAACCA
GGGAAAGCCCCTAAGCTCCTGATCCTTTGGAATTCCCGTTTGCAAAGTGGGGTCCCATCA
CGTTTCAGTGGCAGTGGATCTGGGACAGATTTCACTCTCACCATCAGCAGTCTGCAACCT
GAAGATTTTGCTACGTACTACTGTGCGCAGGCTGGGACGCATCCTACGACGTTCGGCCAA
GGGACCAAGGTGGAAATCAAACGTACGGTGGCTGCACCATCTGAGGTGCAGCTGTTGGAG
TCTGGGGGAGGCTTGGTACAGCCTGGGGGGTCCCTGCGTCTCTCCTGTGCAGCCTCCGGA
TTCACCTTTCGGGATTATGAGATGTGGTGGGTCCGCCAGGCTCCAGGGAAGGGTCTAGAG
CGGGTCTCAGCTATTAATCCGCAGGGTACGCGTACATACTACGCAGACTCCGTGAAGGGC
CGGTTCACCATCTCCCGCGACAATTCCAAGAACACGCTGTATCTGCAAATGAACAGCCTG
CGTGCCGAGGACACCGCGGTATATTACTGTGCGAAACTTCCGTTTTACTTTCAGGAGTGG
GGTCAGGGAACCCTGGTCACCGTCTCCAGC (SEQ ID NO: 1244)

DMS0659 DOM7h-11-87-TVAAPS-BMS3h-56-201
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAGTCTGCAACCT
```

TABLE 22-continued

Polynucleotides Encoding Dual Specificity dAbs
(Table 22 discloses "AST," "TVAAPS," "TVA," "G4S,"
"(G4S)3," "(G4S)5," and "ASTSGPS" disclosed as
SEQ ID NOS 5-7, 1207-1209 and 8, respectively)

```
GAAGATTTTGCTACGTACTACTGTGCGCAGGCTGGGACGCATCATACGACGTTCGGCCAA
GGGACCAAGGTGGAAATCAAACGTACGGTGGCTGCACCATCTGAGGTGCAGCTGTTGGAG
TCTGGGGGAGGCTTGGTACAGCCTGGGGGTCCCTGCGTCTCTCCTGTGCAGCCTCCGGA
TTCACCTTTCGGGATTATGAGATGTGGTGGGTCCGCCAGGCTCCAGGGAAGGGTCTAGAG
CGGGTCTCAGCTATTAATCCGCAGGGTACGCGTACATACTACGCAGACTCCGTGAAGGGC
CGGTTCACCATCTCCCGCGACAATTCCAAGAACACGCTGTATCTGCAAATGAACAGCCTG
CGTGCCGAGGACACCGCGGTATATTACTGTGCGAAACTTCCGTTTTACTTTCAGGAGTGG
GGTCAGGGAACCCTGGTCACCGTCTCCAGC (SEQ ID NO: 1245)

DMS0660 DOM7h-11-3-TVAAPS-BMS3h-56-258
GACATCCAGATGACCCAGTCTCCATCCTCCCTGTCTGCATCTGTAGGAGACCGTGTCACC
ATCACTTGCCGGGCAAGTCGTCCGATTGGGACGACGTTAAGTTGGTACCAGCAGAAACCA
GGGAAAGCCCCTAAGCTCCTGATCCTTTGGAATTCCCGTTTGCAAAGTGGGGTCCCATCA
CGTTTCAGTGGCAGTGGATCTGGGACAGATTTCACTCTCACCATCAGCAGTCTGCAACCT
GAAGATTTTGCTACGTACTACTGTGCGCAGGCTGGGACGCATCCTACGACGTTCGGCCAA
GGGACCAAGGTGGAAATCAAACGTACGGTGGCTGCACCATCTGAGGTGCAGCTGTTGGAG
TCTGGGGGAGGCTTGGTACAGCCTGGGGGTCCCTGCGTCTCTCCTGTGCAGCCTCCGGA
TTCACCTTTCGGGATTATGAGATGTGGTGGGTCCGCCAGGCTCCAGGGAAGGGTCTAGAG
CGGGTCTCAGCTATTAATCCGCAGGGTACGCGTACATACTACGCAGACTCCGTGAAGGGC
CGGTTCACCATCTCCCGCGACAATTCCAAGAACACGCTGTATCTGCAAATGAACAGCCTG
CGTGCCGAGGACACCGCGGTATATTACTGTGCGAAACTTCCGTTTTACTTTCACGAGTGG
GGTCAGGGAACCCTGGTCACCGTCTCCAGC (SEQ ID NO: 1246)

DMS0661 DOM7h-11-87-TVAAPS-BMS3h-56-258
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAGTCTGCAACCT
GAAGATTTTGCTACGTACTACTGTGCGCAGGCTGGGACGCATCATACGACGTTCGGCCAA
GGGACCAAGGTGGAAATCAAACGTACGGTGGCTGCACCATCTGAGGTGCAGCTGTTGGAG
TCTGGGGGAGGCTTGGTACAGCCTGGGGGTCCCTGCGTCTCTCCTGTGCAGCCTCCGGA
TTCACCTTTCGGGATTATGAGATGTGGTGGGTCCGCCAGGCTCCAGGGAAGGGTCTAGAG
CGGGTCTCAGCTATTAATCCGCAGGGTACGCGTACATACTACGCAGACTCCGTGAAGGGC
CGGTTCACCATCTCCCGCGACAATTCCAAGAACACGCTGTATCTGCAAATGAACAGCCTG
CGTGCCGAGGACACCGCGGTATATTACTGTGCGAAACTTCCGTTTTACTTTCACGAGTGG
GGTCAGGGAACCCTGGTCACCGTCTCCAGC (SEQ ID NO: 1247)

DMS0662 DOM7h-11-90-TVAAPS-BMS3h-56-201
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAATCTGCAACCT
GAAGATTTTGCTACGTACTACTGCGCGCAGGCTGGGACGCATCCTACGACGTTCGGCCAA
GGGACCAAGGTGGAAATCAAACGTACGGTGGCTGCACCATCTGAGGTGCAGCTGTTGGAG
TCCGGGGGAGGCTTGGTACAGCCTGGGGGTCCCTGCGTCTCTCCTGTGCAGCCTCCGGA
TTCACCTTTCGGGATTATGAGATGTGGTGGGTCCGCCAGGCTCCAGGGAAGGGTCTAGAG
CGGGTCTCAGCTATTAATCCGCAGGGTACGCGTACATACTACGCAGACTCCGTGAAGGGC
CGGTTCACCATCTCCCGCGACAATTCCAAGAACACGCTGTATCTGCAAATGAACAGCCTG
CGTGCCGAGGACACCGCGGTATATTACTGTGCGAAACTTCCGTTTTACTTTCAGGAGTGG
GGTCAGGGAACCCTGGTCACCGTCTCCAGC (SEQ ID NO: 1248)

DMS0663 DOM7h-11-86-TVAAPS-BMS3h-56-201
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAGTCTGCAACCT
GAAGATGTTGCTACGTACTACTGTGCGCAGGCTGGGACGCATCCTACGACGTTCGGCCAA
GGGACCAAGGTGGAAATCAAACGTACGGTGGCTGCACCATCTGAGGTGCAGCTGTTGGAG
TCTGGGGGAGGCTTGGTACAGCCTGGGGGTCCCTGCGTCTCTCCTGTGCAGCCTCCGGA
TTCACCTTTCGGGATTATGAGATGTGGTGGGTCCGCCAGGCTCCAGGGAAGGGTCTAGAG
CGGGTCTCAGCTATTAATCCGCAGGGTACGCGTACATACTACGCAGACTCCGTGAAGGGC
CGGTTCACCATCTCCCGCGACAATTCCAAGAACACGCTGTATCTGCAAATGAACAGCCTG
CGTGCCGAGGACACCGCGGTATATTACTGTGCGAAACTTCCGTTTTACTTTCAGGAGTGG
GGTCAGGGAACCCTGGTCACCGTCTCCAGC (SEQ ID NO: 1249)

DMS0664 DOM7h-11-69-TVAAPS-BMS3h-56-201
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAGTCTGCAACCT
GAAGATTTTGCTACGTACTACTGTGCGCAGGCTGGGGTCATCCTACGACGTTCGGCCAA
GGGACCAAGGTGGAAATCAAACGTACGGTGGCTGCACCATCTGAGGTGCAGCTGTTGGAG
TCTGGGGGAGGCTTGGTACAGCCTGGGGGTCCCTGCGTCTCTCCTGTGCAGCCTCCGGA
TTCACCTTTCGGGATTATGAGATGTGGTGGGTCCGCCAGGCTCCAGGGAAGGGTCTAGAG
CGGGTCTCAGCTATTAATCCGCAGGGTACGCGTACATACTACGCAGACTCCGTGAAGGGC
```

TABLE 22-continued

Polynucleotides Encoding Dual Specificity dAbs
(Table 22 discloses "AST," "TVAAPS," "TVA," "G4S,"
"(G4S)3," "(G4S)5," and "ASTSGPS" disclosed as
SEQ ID NOS 5-7, 1207-1209 and 8, respectively)

```
CGGTTCACCATCTCCCGCGACAATTCCAAGAACACGCTGTATCTGCAAATGAACAGCCTG
CGTGCCGAGGACACCGCGGTATATTACTGTGCGAAACTTCCGTTTTACTTTCAGGAGTGG
GGTCAGGGAACCCTGGTCACCGTCTCCAGC (SEQ ID NO: 1250)

DMS0667 DOM7h-11-3-TVAAPS-BMS3h-38-240
GACATCCAGATGACCCAGTCTCCATCCTCCCTGTCTGCATCTGTAGGAGACCGTGTCACC
ATCACTTGCCGGGCAAGTCGTCCGATTGGGACGACGTTAAGTTGGTACCAGCAGAAACCA
GGGAAAGCCCCTAAGCTCCTGATCCTTTGGAATTCCCGTTTGCAAAGTGGGGTCCCATCA
CGTTTCAGTGGCAGTGGATCTGGGACAGATTTCACTCTCACCATCAGCAGTCTGCAACCT
GAAGATTTTGCTACGTACTACTGTGCGCAGGCTGGGACGCATCCTACGACGTTCGGCCAA
GGGACCAAGGTGGAAATCAAACGTACGGTGGCTGCACCATCTGAGGTGCAGCTGTTGGAG
TCTGGGGGAGGCTTGGTACAGCCTGGGGGGTCCCTGCGTCTCTCCTGCGCAGCCTCCGGA
TTCACCTTTGAGGAGGAGGAGATGATTTGGGTCCGCCAGGCTCCAGGGAAGGGTCTAGAG
TGGGTCTCAGCTATTAGTAGGAACGGTTACAGCACATACTACGCAGACTCCGTGAAGGGC
CGGTTCACCATCTCCCGCGACAATTCCAAGAACACGCTGTATCTGCAAATGAACAGCCTG
CGTGCCGAGGATACCGCGGTATATTACTGTGGGAAAGAGCCGTTTCGTTATGACTACTGG
GGTCAGGGAACCCTGGTCACCGTCTCCAGC (SEQ ID NO: 1251)

DMS0668 BMS3h-38-240-AST-DOM7h-11-3
GAGGTGCAGCTGTTGGAGTCTGGGGGAGGCTTGGTACAGCCTGGGGGGTCCCTGCGTCTC
TCCTGCGCAGCCTCCGGATTCACCTTTGAGGAGGAGGAGATGATTTGGGTCCGCCAGGCT
CCAGGGAAGGGTCTAGAGTGGGTCTCAGCTATTAGTAGGAACGGTTACAGCACATACTAC
GCAGACTCCGTGAAGGGCCGGTTCACCATCTCCCGCGACAATTCCAAGAACACGCTGTAT
CTGCAAATGAACAGCCTGCGTGCCGAGGATACCGCGGTATATTACTGTGGGAAAGAGCCG
TTTCGTTATGACTACTGGGGTCAGGGAACCCTGGTCACCGTCTCGAGCGCTAGCACCGAC
ATCCAGATGACCCAGTCTCCATCCTCCCTGTCTGCATCTGTAGGAGACCGTGTCACCATC
ACTTGCCGGGCAAGTCGTCCGATTGGGACGACGTTAAGTTGGTACCAGCAGAAACCAGGG
AAAGCCCCTAAGCTCCTGATCCTTTGGAATTCCCGTTTGCAAAGTGGGGTCCCATCACGT
TTCAGTGGCAGTGGATCTGGGACAGATTTCACTCTCACCATCAGCAGTCTGCAACCTGAA
GATTTTGCTACGTACTACTGTGCGCAGGCTGGGACGCATCCTACGACGTTCGGCCAAGGG
ACCAAGGTGGAAATCAAACGG (SEQ ID NO: 1252)

DMS0669 DOM7h-14-10-TVAAPS-BMS3h-38-240
GACATCCAGATGACCCAGTCTCCATCCTCCCTGTCTGCATCTGTAGGAGACCGTGTCACC
ATCACTTGCCGGGCAAGTCAGTGGATTGGGTCTCAGTTATCTTGGTACCAGCAGAAACCA
GGGAAAGCCCCTAAGCTCCTGATCATGTGGCGTTCCTCGTTGCAAAGTGGGGTCCCATCA
CGTTTCAGTGGCAGTGGATCTGGGACAGATTTCACTCTCACCATCAGCAGTCTGCAACCT
GAAGATTTTGCTACGTACTACTGTGCTCAGGGTTTGAGGCATCCTAAGACGTTCGGCCAA
GGGACCAAGGTGGAAATCAAACGTACGGTGGCTGCACCATCTGAGGTGCAGCTGTTGGAG
TCTGGGGGAGGCTTGGTACAGCCTGGGGGGTCCCTGCGTCTCTCCTGCGCAGCCTCCGGA
TTCACCTTTGAGGAGGAGGAGATGATTTGGGTCCGCCAGGCTCCAGGGAAGGGTCTAGAG
TGGGTCTCAGCTATTAGTAGGAACGGTTACAGCACATACTACGCAGACTCCGTGAAGGGC
CGGTTCACCATCTCCCGCGACAATTCCAAGAACACGCTGTATCTGCAAATGAACAGCCTG
CGTGCCGAGGATACCGCGGTATATTACTGTGGGAAAGAGCCGTTTCGTTATGACTACTGG
GGTCAGGGAACCCTGGTCACCGTCTCCAGC (SEQ ID NO: 1253)

DMS0670 BMS3h-38-240-AST-DOM7h-14-10
GAGGTGCAGCTGTTGGAGTCTGGGGGAGGCTTGGTACAGCCTGGGGGGTCCCTGCGTCTC
TCCTGCGCAGCCTCCGGATTCACCTTTGAGGAGGAGGAGATGATTTGGGTCCGCCAGGCT
CCAGGGAAGGGTCTAGAGTGGGTCTCAGCTATTAGTAGGAACGGTTACAGCACATACTAC
GCAGACTCCGTGAAGGGCCGGTTCACCATCTCCCGCGACAATTCCAAGAACACGCTGTAT
CTGCAAATGAACAGCCTGCGTGCCGAGGATACCGCGGTATATTACTGTGGGAAAGAGCCG
TTTCGTTATGACTACTGGGGTCAGGGAACCCTGGTCACCGTCTCGAGCGCTAGCACCGAC
ATCCAGATGACCCAGTCTCCATCCTCCCTGTCTGCATCTGTAGGAGACCGTGTCACCATC
ACTTGCCGGGCAAGTCAGTGGATTGGGTCTCAGTTATCTTGGTACCAGCAGAAACCAGGG
AAAGCCCCTAAGCTCCTGATCATGTGGCGTTCCTCGTTGCAAAGTGGGGTCCCATCACGT
TTCAGTGGCAGTGGATCTGGGACAGATTTCACTCTCACCATCAGCAGTCTGCAACCTGAA
GATTTTGCTACGTACTACTGTGCTCAGGGTTTGAGGCATCCTAAGACGTTCGGCCAAGGG
ACCAAGGTGGAAATCAAACGG (SEQ ID NO: 1254)

DMS0671 BMS3h-38-235-AST-DOM7h-11-3
GAGGTGCAGCTGTTGGCGTCTGGGGGAGGCTTGGTACAGCCTGGGGGGTCCCTGCGTCTC
TCCTGCGCAGCCTCCGGATTCACCTTTGAGGAGGAGGAGATGATTTGGGTCCGCCAGGCT
CCAGGGAAGGGTCTAGAGTGGGTCTCAGCTATTAGTAGGAACGGTTACAGCACATACTAC
GCAGACTCCGTGAAGGGCCGGTTCACCATCTCCCGCGACAATTCCAAGAACACGCTGTAT
CTGCAAATGAACAGCCTGCGTGCCGAGGATACCGCGGTATATTACTGTGGGAAAGAGCCG
TTTCGTTATGACTACTGGGGTCAGGGAACCCTGGTCACCGTCTCGAGCGCTTCAACCGAC
ATCCAGATGACCCAGTCTCCATCCTCCCTGTCTGCATCTGTAGGAGACCGTGTCACCATC
ACTTGCCGGGCAAGTCGTCCGATTGGGACGACGTTAAGTTGGTACCAGCAGAAACCAGGG
AAAGCCCCTAAGCTCCTGATCCTTTGGAATTCCCGTTTGCAAAGTGGGGTCCCATCACGT
TTCAGTGGCAGTGGATCTGGGACAGATTTCACTCTCACCATCAGCAGTCTGCAACCTGAA
GATTTTGCTACGTACTACTGTGCGCAGGCTGGGACGCATCCTACGACGTTCGGCCAAGGG
ACCAAGGTGGAAATCAAACGG (SEQ ID NO: 1255)
```

TABLE 22-continued

Polynucleotides Encoding Dual Specificity dAbs
(Table 22 discloses "AST," "TVAAPS," "TVA," "G4S,"
"(G4S)3," "(G4S)5," and "ASTSGPS" disclosed as
SEQ ID NOS 5-7, 1207-1209 and 8, respectively)

DMS0672 BMS3h-38-235-AST-DOM7h-11-90
GAGGTGCAGCTGTTGGCGTCTGGGGGAGGCTTGGTACAGCCTGGGGGGTCCCTGCGTCTC
TCCTGCGCAGCCTCCGGATTCACCTTTGAGGAGGAGGAGATGATTTGGGTCCGCCAGGCC
CCAGGGAAGGGTCTAGAGTGGGTCTCAGCTATTAGTAGGAACGGTTACAGCACATACTAC
GCAGACTCCGTGAAGGGCCGGTTCACCATCTCCCGCGACAATTCCAAGAACACGCTGTAT
CTGCAAATGAACAGCCTGCGTGCCGAGGATACCGCGGTATATTACTGTGGGAAAGAGCCG
TTTCGTTATGACTACTGGGGTCAGGGAACCCTGGTCACCGTCTCGAGCGCTTCAACCGAC
ATCCAGATGACCCAGTCTCCATCCTCCCTGTCTGCATCTGTAGGAGACCGTGTCACCATC
ACTTGCCGGGCAAGTCGTCCGATTGGGACGATGTTAAGTTGGTACCAGCAGAAACCAGGG
AAAGCCCCTAAGCTCCTGATCCTTGCTTTTTCCCGTTTGCAAAGTGGGGTCCCATCACGT
TTCAGTGGCAGTGGATCTGGGACAGATTTCACTCTCACCATCAGCAATCTGCAACCTGAA
GATTTTGCTACGTACTACTGCGCGCAGGCTGGGACGCATCCTACGACGTTCGGCCAAGGG
ACCAAGGTGGAAATCAAACGG (SEQ ID NO: 1256)

DMS0674 DOM7h-11-3-TVAAPS-BMS3h-38-235
GACATCCAGATGACCCAGTCTCCATCCTCCCTGTCTGCATCTGTAGGAGACCGTGTCACC
ATCACTTGCCGGGCAAGTCGTCCGATTGGGACGACGTTAAGTTGGTACCAGCAGAAACCA
GGGAAAGCCCCTAAGCTCCTGATCCTTTGGAATTCCCGTTTGCAAAGTGGGGTCCCATCA
CGTTTCAGTGGCAGTGGATCTGGGACAGATTTCACTCTCACCATCAGCAGTCTGCAACCT
GAAGATTTTGCTACGTACTACTGTGCGCAGGCTGGGACGCATCCTACGACGTTCGGCCAA
GGGACCAAGGTGGAAATCAAACGGACCGTGGCGGCGCCGAGTGAGGTGCAGCTGTTGGCG
TCTGGGGGAGGCTTGGTACAGCCTGGGGGGTCCCTGCGTCTCTCCTGCGCAGCCTCCGGA
TTCACCTTTGAGGAGGAGGAGATGATTTGGGTCCGCCAGGCTCCAGGGAAGGGTCTAGAG
TGGGTCTCAGCTATTAGTAGGAACGGTTACAGCACATACTACGCAGACTCCGTGAAGGGC
CGGTTCACCATCTCCCGCGACAATTCCAAGAACACGCTGTATCTGCAAATGAACAGCCTG
CGTGCCGAGGATACCGCGGTATATTACTGTGGGAAAGAGCCGTTTCGTTATGACTACTGG
GGTCAGGGAACCCTGGTCACCGTCTCCAGC (SEQ ID NO: 1257)

DMS0675 DOM7h-11-90-TVAAPS-BMS3h-38-235
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAATCTGCAACCT
GAAGATTTTGCTACGTACTACTGCGCGCAGGCTGGGACGCATCCTACGACGTTCGGCCAA
GGGACCAAGGTGGAAATCAAACGGACCGTGGCGGCGCCGAGTGAGGTGCAACTGTTGGCG
TCTGGGGGAGGCTTGGTACAGCCTGGGGGGTCCCTGCGTCTCTCCTGCGCAGCCTCCGGA
TTCACCTTTGAGGAGGAGGAGATGATTTGGGTCCGCCAGGCTCCAGGGAAGGGTCTAGAG
TGGGTCTCAGCTATTAGTAGGAACGGTTACAGCACATACTACGCAGACTCCGTGAAGGGC
CGGTTCACCATCTCCCGCGACAATTCCAAGAACACGCTGTATCTGCAAATGAACAGCCTG
CGTGCCGAGGATACCGCGGTATATTACTGTGGGAAAGAGCCGTTTCGTTATGACTACTGG
GGTCAGGGAACCCTGGTCACCGTCTCCAGC (SEQ ID NO: 1258)

DMS0677 DOM7h-11-90-TVA-BMS3h-56-258
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAATCTGCAACCT
GAAGATTTTGCTACGTACTACTGCGCGCAGGCTGGGACGCATCCTACGACGTTCGGCCAA
GGGACCAAGGTGGAAATCAAACGTACGGTGGCGGAGGTGCAGCTGTTGGAGTCTGGGGGA
GGCTTGGTACAGCCTGGGGGGTCCCTGCGTCTCTCCTGTGCAGCCTCCGGATTCACCTTT
CGGGATTATGAGATGTGGTGGGTCCGCCAGGCTCCAGGGAAGGGTCTAGAGCGGGTCTCA
GCTATTAATCCGCAGGGTACGCGTACATACTACGCAGACTCCGTGAAGGGCCGGTTCACC
ATCTCCCGCGACAATTCCAAGAACACGCTGTATCTGCAAATGAACAGCCTGCGTGCCGAG
GACACCGCGGTATATTACTGTGCGAAACTTCCGTTTTACTTTCACGAGTGGGGTCAGGGA
ACCCTGGTCACCGTCTCCAGC (SEQ ID NO: 1259)

DMS0678 DOM7h-11-90-ASTSGPS-BMS3h-56-258
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAATCTGCAACCT
GAAGATTTTGCTACGTACTACTGCGCGCAGGCTGGGACGCATCCTACGACGTTCGGCCAA
GGGACCAAGGTGGAAATCAAACGGGCTAGCACCTCAGGTCCATCGGAGGTGCAGCTGTTG
GAGTCTGGGGGAGGCTTGGTACAGCCTGGGGGGTCCCTGCGTCTCTCCTGTGCAGCCTCC
GGATTCACCTTTCGGGATTATGAGATGTGGTGGGTCCGCCAGGCTCCAGGGAAGGGTCTA
GAGCGGGTCTCAGCTATTAATCCGCAGGGTACGCGTACATACTACGCAGACTCCGTGAAG
GGCCGGTTCACCATCTCCCGCGACAATTCCAAGAACACGCTGTATCTGCAAATGAACAGC
CTGCGTGCCGAGGACACCGCGGTATATTACTGTGCGAAACTTCCGTTTTACTTTCACGAG
TGGGGTCAGGGAACCCTGGTCACCGTCTCCAGC (SEQ ID NO: 1260)

DMS0679 DOM7h-11-90-G4S-BMS3h-56-258
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA

TABLE 22-continued

Polynucleotides Encoding Dual Specificity dAbs
(Table 22 discloses "AST," "TVAAPS," "TVA," "G4S,"
"(G4S)3," "(G4S)5," and "ASTSGPS" disclosed as
SEQ ID NOS 5-7, 1207-1209 and 8, respectively)

CGTTTCAGTGGCAGTGGATCTGGGACAGATTTCACTCTCACCATCAGCAATCTGCAACCT
GAAGATTTTGCTACGTACTACTGCGCGCAGGCTGGGACGCATCCTACGACGTTCGGCCAA
GGGACCAAGGTGGAAATCAAACGGGGTGGAGGTGGCTCTGAGGTGCAGCTGTTGGAGTCT
GGGGGAGGCTTGGTACAGCCTGGGGGGTCCCTGCGTCTCTCCTGTGCAGCCTCCGGATTC
ACCTTTCGGGATTATGAGATGTGGTGGGTCCGCCAGGCTCCAGGGAAGGGTCTAGAGCGG
GTCTCAGCTATTAATCCGCAGGGTACGCGTACATACTACGCAGACTCCGTGAAGGGCCGG
TTCACCATCTCCCGCGACAATTCCAAGAACACGCTGTATCTGCAAATGAACAGCCTGCGT
GCCGAGGACACCGCGGTATATTACTGTGCGAAACTTCCGTTTTACTTTCACGAGTGGGGT
CAGGGAACCCTGGTCACCGTCTCCAGC (SEQ ID NO: 1261)

DMS0680 DOM7h-11-90-(G4S)3-BMS3h-56-258
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAATCTGCAACCT
GAAGATTTTGCTACGTACTACTGCGCGCAGGCTGGGACGCATCCTACGACGTTCGGCCAA
GGGACCAAGGTGGAAATCAAACGGGGTGGAGGTGGCTCTGGAGGTGGCGGTAGCGGCGGA
GGCGGTTCAGAGGTGCAGCTGTTGGAGTCTGGGGGAGGCTTGGTACAGCCTGGGGGGTCC
CTGCGTCTCTCCTGTGCAGCCTCCGGATTCACCTTTCGGGATTATGAGATGTGGTGGGTC
CGCCAGGCTCCAGGGAAGGGTCTAGAGCGGGTCTCAGCTATTAATCCGCAGGGTACGCGT
ACATACTACGCAGACTCCGTGAAGGGCCGGTTCACCATCTCCCGCGACAATTCCAAGAAC
ACGCTGTATCTGCAAATGAACAGCCTGCGTGCCGAGGACACCGCGGTATATTACTGTGCG
AAACTTCCGTTTTACTTTCACGAGTGGGGTCAGGGAACCCTGGTCACCGTCTCCAGC (SEQ ID
NO: 1262)

DMS0681 DOM7h-11-90-(G4S)5-BMS3h-56-258
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAATCTGCAACCT
GAAGATTTTGCTACGTACTACTGCGCGCAGGCTGGGACGCATCCTACGACGTTCGGCCAA
GGGACCAAGGTGGAAATCAAACGGGGTGGAGGTGGCTCTGGAGGTGGCGGTAGCGGCGGT
GGCGGTTCAGGTGGCGGAGGTTCTGGAGGCGGTGGATCTGAGGTGCAGCTGTTGGAGTCT
GGGGGAGGCTTGGTACAGCCTGGGGGGTCCCTGCGTCTCTCCTGTGCAGCCTCCGGATTC
ACCTTTCGGGATTATGAGATGTGGTGGGTCCGCCAGGCTCCAGGGAAGGGTCTAGAGCGG
GTCTCAGCTATTAATCCGCAGGGTACGCGTACATACTACGCAGACTCCGTGAAGGGCCGG
TTCACCATCTCCCGCGACAATTCCAAGAACACGCTGTATCTGCAAATGAACAGCCTGCGT
GCCGAGGACACCGCGGTATATTACTGTGCGAAACTTCCGTTTTACTTTCACGAGTGGGGT
CAGGGAACCCTGGTCACCGTCTCCAGC (SEQ ID NO: 1263)

DMS0682 BMS3h-56-258-TVA-DOM7h-11-90
GAGGTGCAGCTGTTGGAGTCTGGGGGAGGCTTGGTACAGCCTGGGGGGTCCCTGCGTCTC
TCCTGTGCAGCCTCCGGATTCACCTTTCGGGATTATGAGATGTGGTGGGTCCGCCAGGCT
CCAGGGAAGGGTCTAGAGCGGGTCTCAGCTATTAATCCGCAGGGTACGCGTACATACTAC
GCAGACTCCGTGAAGGGCCGGTTCACCATCTCCCGCGACAATTCCAAGAACACGCTGTAT
CTGCAAATGAACAGCCTGCGTGCCGAGGACACCGCGGTATATTACTGTGCGAAACTTCCG
TTTTACTTTCACGAGTGGGGTCAGGGAACCCTGGTCACCGTTTCGAGCACGGTGGCGGAC
ATCCAGATGACCCAGTCTCCATCCTCCCTGTCTGCATCTGTAGGAGACCGTGTCACCATC
ACTTGCCGGGCAAGTCGTCCGATTGGGACGATGTTAAGTTGGTACCAGCAGAAACCAGGG
AAAGCCCCTAAGCTCCTGATCCTTGCTTTTTCCCGTTTGCAAAGTGGGGTCCCATCACGT
TTCAGTGGCAGTGGATCTGGGACAGATTTCACTCTCACCATCAGCAATCTGCAACCTGAA
GATTTTGCTACGTACTACTGCGCGCAGGCTGGGACGCATCCTACGACGTTCGGCCAAGGG
ACCAAGGTGGAAATCAAACGG (SEQ ID NO: 1264)

DMS0683 BMS3h-56-258-ASTSGPS-DOM7h-11-90
GAGGTGCAGCTGTTGGAGTCTGGGGGAGGCTTGGTACAGCCTGGGGGGTCCCTGCGTCTC
TCCTGTGCAGCCTCCGGATTCACCTTTCGGGATTATGAGATGTGGTGGGTCCGCCAGGCT
CCAGGGAAGGGTCTAGAGCGGGTCTCAGCTATTAATCCGCAGGGTACGCGTACATACTAC
GCAGACTCCGTGAAGGGCCGGTTCACCATCTCCCGCGACAATTCCAAGAACACGCTGTAT
CTGCAAATGAACAGCCTGCGTGCCGAGGACACCGCGGTATATTACTGTGCGAAACTTCCG
TTTTACTTTCACGAGTGGGGTCAGGGAACCCTGGTCACCGTCTCGAGCGCTAGCACCTCA
GGTCCATCGGACATCCAGATGACCCAGTCTCCATCCTCCCTGTCTGCATCTGTAGGAGAC
CGTGTCACCATCACTTGCCGGGCAAGTCGTCCGATTGGGACGATGTTAAGTTGGTACCAG
CAGAAACCAGGGAAAGCCCCTAAGCTCCTGATCCTTGCTTTTTCCCGTTTGCAAAGTGGG
GTCCCATCACGTTTCAGTGGCAGTGGATCTGGGACAGATTTCACTCTCACCATCAGCAAT
CTGCAACCTGAAGATTTTGCTACGTACTACTGCGCGCAGGCTGGGACGCATCCTACGACG
TTCGGCCAAGGGACCAAGGTGGAAATCAAACGG (SEQ ID NO: 1265)

DMS0684 BMS3h-56-258-G4S-DOM7h-11-90
GAGGTGCAGCTGTTGGAGTCTGGGGGAGGCTTGGTACAGCCTGGGGGGTCCCTGCGTCTC
TCCTGTGCAGCCTCCGGATTCACCTTTCGGGATTATGAGATGTGGTGGGTCCGCCAGGCT
CCAGGGAAGGGTCTAGAGCGGGTCTCAGCTATTAATCCGCAGGGTACGCGTACATACTAC
GCAGACTCCGTGAAGGGCCGGTTCACCATCTCCCGCGACAATTCCAAGAACACGCTGTAT
CTGCAAATGAACAGCCTGCGTGCCGAGGACACCGCGGTATATTACTGTGCGAAACTTCCG
TTTTACTTTCACGAGTGGGGTCAGGGAACCCTGGTCACCGTCTCGAGCGGTGGAGGCGGC

TABLE 22-continued

Polynucleotides Encoding Dual Specificity dAbs
(Table 22 discloses "AST," "TVAAPS," "TVA," "G4S,"
"(G4S)3," "(G4S)5," and "ASTSGPS" disclosed as
SEQ ID NOS 5-7, 1207-1209 and 8, respectively)

```
TCTGACATCCAGATGACCCAGTCTCCATCCTCCCTGTCTGCATCTGTAGGAGACCGTGTC
ACCATCACTTGCCGGGCAAGTCGTCCGATTGGGACGATGTTAAGTTGGTACCAGCAGAAA
CCAGGGAAAGCCCCTAAGCTCCTGATCCTTGCTTTTTCCCGTTTGCAAAGTGGGGTCCCA
TCACGTTTCAGTGGCAGTGGATCTGGGACAGATTTCACTCTCACCATCAGCAATCTGCAA
CCTGAAGATTTTGCTACGTACTACTGCGCGCAGGCTGGGACGCATCCTACGACGTTCGGC
CAAGGGACCAAGGTGGAAATCAAACGG (SEQ ID NO: 1266)

DMS0685 BMS3h-56-258-(G4S)3-DOM7h-11-90
GAGGTGCAGCTGTTGGAGTCTGGGGGAGGCTTGGTACAGCCTGGGGGGTCCCTGCGTCTC
TCCTGTGCAGCCTCCGGATTCACCTTTCGGGATTATGAGATGTGGTGGGTCCGCCAGGCT
CCAGGGAAGGGTCTAGAGCGGGTCTCAGCTATTAATCCGCAGGGTACGCGTACATACTAC
GCAGACTCCGTGAAGGGCCGGTTCACCATCTCCCGCGACAATTCCAAGAACACGCTGTAT
CTGCAAATGAACAGCCTGCGTGCCGAGGACACCGCGGTATATTACTGTGCGAAACTTCCG
TTTTACTTTCACGAGTGGGGTCAGGGAACCCTGGTCACCGTCTCGAGCGGTGGAGGTGGC
TCTGGAGGTGGCGGTAGCGGCGGTGGCGGTTCAGACATCCAGATGACCCAGTCTCCATCC
TCCCTGTCTGCATCTGTAGGAGACCGTGTCACCATCACTTGCCGGGCAAGTCGTCCGATT
GGGACGATGTTAAGTTGGTACCAGCAGAAACCAGGGAAAGCCCCTAAGCTCCTGATCCTT
GCTTTTTCCCGTTTGCAAAGTGGGGTCCCATCACGTTTCAGTGGCAGTGGATCTGGGACA
GATTTCACTCTCACCATCAGCAATCTGCAACCTGAAGATTTTGCTACGTACTACTGCGCG
CAGGCTGGGACGCATCCTACGACGTTCGGCCAAGGGACCAAGGTGGAAATCAAACGG (SEQ ID
NO: 1267)

DMS0686 BMS3h-56-258-(G4S)5-DOM7h-11-90
GAGGTGCAGCTGTTGGAGTCTGGGGGAGGCTTGGTACAGCCTGGGGGGTCCCTGCGTCTC
TCCTGTGCAGCCTCCGGATTCACCTTTCGGGATTATGAGATGTGGTGGGTCCGCCAGGCT
CCAGGGAAGGGTCTAGAGCGGGTCTCAGCTATTAATCCGCAGGGTACGCGTACATACTAC
GCAGACTCCGTGAAGGGCCGGTTCACCATCTCCCGCGACAATTCCAAGAACACGCTGTAT
CTGCAAATGAACAGCCTGCGTGCCGAGGACACCGCGGTATATTACTGTGCGAAACTTCCG
TTTTACTTTCACGAGTGGGGTCAGGGAACCCTGGTCACCGTCTCGAGCGGTGGAGGTGGC
TCTGGAGGTGGCGGTAGCGGCGGTGGCGGTTCAGGTGGCGGAGGTTCTGGAGGCGGTGGA
TCTGACATCCAGATGACCCAGTCTCCATCCTCCCTGTCTGCATCTGTAGGAGACCGTGTC
ACCATCACTTGCCGGGCAAGTCGTCCGATTGGGACGATGTTAAGTTGGTACCAGCAGAAA
CCAGGGAAAGCCCCTAAGCTCCTGATCCTTGCTTTTTCCCGTTTGCAAAGTGGGGTCCCA
TCACGTTTCAGTGGCAGTGGATCTGGGACAGATTTCACTCTCACCATCAGCAATCTGCAA
CCTGAAGATTTTGCTACGTACTACTGCGCGCAGGCTGGGACGCATCCTACGACGTTCGGC
CAAGGGACCAAGGTGGAAATCAAACGG (SEQ ID NO: 1268)

DMS0688 DOM7h-11-90-TVAAPS-BMS3h-56-258
GACATCCAGATGACCCAGTCTCCATCCTCCCTGTCTGCATCTGTAGGAGACCGTGTCACC
ATCACTTGCCGGGCAAGTCGTCCGATTGGGACGATGTTAAGTTGGTACCAGCAGAAACCA
GGGAAAGCCCCTAAGCTCCTGATCCTTGCTTTTTCCCGTTTGCAAAGTGGGGTCCCATCA
CGTTTCAGTGGCAGTGGATCTGGGACAGATTTCACTCTCACCATCAGCAATCTGCAACCT
GAAGATTTTGCTACGTACTACTGCGCGCAGGCTGGGACGCATCCTACGACGTTCGGCCAA
GGGACCAAGGTGGAAATCAAACGGACCGTAGCGGCGCCGAGTGAGGTGCAGCTGTTGGAG
TCTGGGGGAGGCTTGGTACAGCCTGGGGGGTCCTGCGTCTCTCCTGTGCAGCCTCCGGA
TTCACCTTTCGGGATTATGAGATGTGGTGGGTCCGCCAGGCTCCAGGGAAGGGTCTAGAG
CGGGTCTCAGCTATTAATCCGCAGGGTACGCGTACATACTACGCAGACTCCGTGAAGGGC
CGGTTCACCATCTCCCGCGACAATTCCAAGAACACGCTGTATCTGCAAATGAACAGCCTG
CGTGCCGAGGACACCGCGGTATATTACTGTGCGAAACTTCCGTTTTACTTTCACGAGTGG
GGTCAGGGAACCCTGGTCACCGTCTCCAGC (SEQ ID NO: 1269)
```

Example 8

Anti-Cynomolgus CD40 dAbs

The methods disclosed herein to generate antibody polypeptides that specifically bind human CD40 may be used to generate antibody polypeptides that specifically bind CD40 of other species. For example, anti-cynomolgus (anti-cyno) CD40 antibody polypeptides can be produced using the presently disclosed methods. The anti-cynoCD40 antibody polypeptides can be generated using the same scheme of initial/primary screening and affinity maturation as anti-human CD40 dAbs, for example. Methods for obtaining anti-cynoCD40 dAbs are disclosed, and representative examples of anti-cynoCD40 dAbs are provided in TABLE 23 below.

ELISA RBA:

Clear walled Highbind, 384 well plates (Corning, UK) were coated with 25 µl of 1 µg/ml neutravidin in carbonate buffer overnight at 4° C. The following day, assay plates were washed with 0.1% Tween PBS buffer, blocked with 1% BSA in PBS for 1 hour at room temperature, and washed again. Following removal of excess washing buffer, 25 µl of 1 µg/ml of biotinylated human IZ-CD40L (BMS, 1.2 mg/ml stock concentration) was incubated with the assay plates for 1 hour at room temperature. Simultaneously, a dilution range of purified dAb and 1 µg/ml of cynoCD40 (BMS) were complexed in a 1:1 ratio. Following washing of the assay plate, the dAb:cyno CD40 complex was incubated in the assay plate at room temperature for 2 hours with gentle agitation. Competitive binding of dAb vs. cynoCD40 to biotinylated CD40L was detected with horse radish peroxidase (HRP) conjugated anti human (Fc) secondary antibody (Sigma-Aldrich, UK). Absorbance signal was measured using a Spectromax M5e plate reader (Molecular Devices) at 450 nm following neutralization with 1M HCl.

cynoCD40 CHO Cell RBA Using AB8200 FMAT:

Stably transfected cynoCD40-expressing CHO-DG44 cells or native CHO-DG44 cells (BMS) were detached from cell culture flasks using Versene (Invitrogen). 40,000 cells per well were seeded into 96 well Highbind, black walled, clear bottom plates (Corning, UK) in 0.1% BSA PBS assay buffer with a dilution range of dAb, 0.25 µg/ml of biotinylated human IZ-CD40L (BMS, 1.2 mg/ml stock concentration), and 0.25 µg/ml of streptavidin Alexa Fluor 647 (Invitrogen, Molecular probes, UK). The mixture was incubated in the absence of light for 6 hours. Following incubation, competitive binding of dAb vs. cynoCD40 CHO cells to soluble biotinylated IZ-CD40L was assessed using relative fluorescence as measured by the AB8200 cellular detection platform (Applied Biosystems).

antibody in a final volume of 200 µl/well in a 96-well round bottom plate. The plates were incubated at 37° C. for 72 hours, following which thymidine ($^3$H; 0.5 µci/well) was added for 6 hours. B cell proliferation was quantified based on thymidine incorporation. All assays, unless otherwise noted, were performed in RPMI media supplemented with 10% fetal calf serum (FCS).

Soluble IZ-hCD40L-Driven Cyno Splenic B Cell Proliferation:

$1 \times 10^5$ B cells isolated from cynomolgous monkey spleens were incubated with 0.5 µg/ml of IZ-hCD40L along with varying titration of dAb or mAb in a final volume of 200 µl/well in a 96-well round bottom plate. The plates were incubated at 37° C. for 72 hours, following which $^3$H-thymidine (µci/well) was added for 6 hours. B cell proliferation was quantified based on thymidine incorporation. All assays, unless otherwise noted, were performed in RPMI media supplemented with 10% fetal calf serum (FCS).

TABLE 23

| Clone | ELISA RBA (nM) | Cell RBA (nM) | B cell proliferation assay (EC50 nM) | |
|---|---|---|---|---|
| | | | Human | Cyno |
| BMS5c8 | | | | 8, 10, 12, 8, 8 |
| BMS3c-85 | 370 | | >7000, >7000 | 747, 2700, 7000, 7000 |
| BMS3c-85-1 | 52,8 | 12 | 2600, 1100 | 18, 39, 47 |
| BMS3c-85-2 | 12,4 | 4, 17 | 1800, 800 | 2, 5, 6, 1 |
| BMS3c-85-3 | 7 | 23 | >7000, >7000 | 33, 31, 21, 31 |
| BMS3c-85-8 | 22 | 17.2 | >7000, >7000 | 33, 33, 25 |
| BMS3c-85-9 | 10 | | >7000, >7000 | >70, >70, 104 |
| BMS3c-85-21 | 11 | 18 | | 24 |
| BMS3c-85-24 | 8 | 13, 14 | | |
| BMS3c-85-25 | 62 | | | |
| BMS3c-85-26 | 3 | | 3300, 3900 | >70, >70, 385 |
| BMS3c-85-27 | 13 | 23 | | 39 |
| BMS3c-85-31 | 13 | 11, 9 | | |
| BMS3c-85-32 | 21 | 56 | | 111 |
| BMS3c-85-33 | 15 | 10, 21.3 | | 17 |
| BMS3c-85-34 | 48 | | | |
| BMS3c-85-35 | — | 19, 1.5 | >700 | 2 |
| BMS3c-85-36 | — | 28 | | |
| BMS3c-85-37 | — | 71 | | |
| BMS3c-85-38 | — | 17 | | |
| BMS3c-85-47 | — | 2.9 | >700 | <2, 0.5 |
| BMS3c-85-49 | — | 10 | >700 | 3, 3 |
| BMS3c-85-51 | — | 2.5 | >700 | 3 |
| BMS3c-85-52 | — | 8.5 | | |
| BMS3c-85-55 | — | 13.3, 6.7 | >700 | 3, 3 |
| BMS3c-85-56 | — | no convergence | | |
| BMS3c-85-57 | — | 13.8, 5.3 | >700 | 2, 4 |
| BMS3c-85-62 | — | 9.9, 2.7, 2.0 | >700 | <2, 0.63 |
| BMS3c-85-63 | — | 80.9 | | |
| BMS3c-85-64 | — | 16.1 | | |
| BMS3c-85-65 | — | 13.9, 7.4 | >700 | 3, 2 |
| BMS3c-85-67 | — | 1.5 | | 0.17 |
| BMS3c-85-69 | — | 1.8 | | 0.33 |
| BMS3c-85-72 | — | 2 | | 0.16 |
| BMS3c-85-73 | — | 2.3 | | |
| BMS3c-85-77 | — | 2.3 | | 0.2 |
| BMS3c-85-84 | — | 1.3 | | 0.21 |
| BMS3c-85-88 | — | 3 | | 0.25 |
| BMS3c-85-91 | — | 1.3 | | 0.26 |

CHO-hCD40L-Driven Primary Human B Cell Proliferation:

CHO cells (ATCC) were transfected with human CD40L to generate a stable cell line expressing high levels of CD40L on the cell surface. CHO-CD40L cells were irradiated at 10,000 Rads before incubation with human B cells. $1 \times 10^5$ tonsillar human B cells were incubated with $1 \times 10^3$ CHO-CD40L cells (1:100 ratio of CHO-CD40L: human B cells) along with varying titration of dAb or monoclonal Example 9

Anti-Human CD40 dAbs do not Bind CynoCD40

CynoCD40 has a Leu109 residue instead of a Trp109, as in human CD40. The amino acid sequence of *Macaca fascicularis* CD40 is reproduced below:

```
                                              (SEQ ID NO: 2)
  1 MVRLPLQCVL WGCLLTAVYP EPPTACREKQ YLINSQCCSL
    CQPGQKLVSD

51 CTEFTETECL PCGESEFLDT WNRETRCHQH KYCDPNLGLR
    VQQKGTSETD

101 TICTCEEGLH CTSESCESCV PHRSCLPGFG VKQIATGVSD
    TICEPCPVGF

151 FSNVSSAFEK CRPWTSCETK DLVVQQAGTN KTDVVCGPQD
    RQRALVVIPI

201 CLGILFVILL LVLVFIKKVA KKPNDKVPHP KQEPQEINFP
    DDLPGSNPAA

251 PVQETLHGCQ PVTQEDGKES RISVQERQ
```

Anti-human CD40 dAbs were tested for cross reactivity to B cells in cynomolgus monkey, rhesus macaque and chimpanzee blood, and lymphocytes from marmoset blood using flow cytometric methods. The procedures detailed below summarize methods used for CD40 dAb detection over multiple experiments. The results, shown in TABLE 24, suggest that anti-human CD40 dAbs do not bind cynoCD40. This is consistent with the evidence disclosed above (see FIGS. 1 and 2) that Trp109 in human CD40 (which is absent in cynoCD40) is important for complex formation between the dAbs and human CD40.

Methods:

PEGylated anti-human CD40 dAbs (BMS3h-56-5C-40L and BMS3h38-2C-P40Br) or a biotin-conjugated dAb (BMS3h38-2-biotin) were incubated with human and primate blood samples on a rotator for 1 hour at 37° C. 100 µl from each blood sample was aliquoted to 12×75 mm tubes and washed 3 times with FACS buffer (0.5% FBS/PBS/0.1% sodium azide). Tubes were centrifuged for 5 minutes at 1500 rpm, and supernatants were decanted between washes. Following the washes, tubes were placed on ice and incubated with human IgG for 5 minutes to block non-specific binding via Fc receptors.

For PEGylated dAb detection, anti-PEG antibodies (clone CH-2074, Silver Lake Research or clone 2-2, Open Biosystems) were added to tubes and incubated for 30 minutes. Samples were washed once in FACS buffer, then incubated with an APC-labeled CD20 antibody (clone 2H7, BD Biosciences) and PE labeled-anti-mouse IgG (Fcγ1 specific; Calbiochem) for an additional 30 minutes on ice.

For biotin-conjugated dAb detection, PE-labeled streptavidin (Invitrogen) and APC-labeled $CD_{20}$ antibody (clone 2H7, BD Biosciences) were added to tubes and incubated 30 minutes at room temperature.

Additionally, to measure CD40 levels on human and primate blood, an aliquot of each blood sample was incubated with an APC-labeled $CD_{20}$ antibody (clone 2H7, BD Biosciences) and a PE-labeled anti-human CD40 antibody that cross reacts with primate species (clone 5C3, BD Biosciences) for 30 minutes at room temperature.

To lyse red blood cells and fix white blood cells following detection antibody incubation, FACS Lysing Solution (BD Biosciences) was added to all tubes, and samples were incubated for 15 minutes at room temperature. Samples were centrifuged and resuspended in FACS Lysing Solution, and analyzed by flow cytometry on a BD FACSCanto™, gating on CD20+ B cells for analysis. For marmoset samples, the $CD_{20}$ antibody was not cross reactive; therefore analysis was performed on all lymphocytes as identified by forward and side scatter properties (size).

Figure 3A:
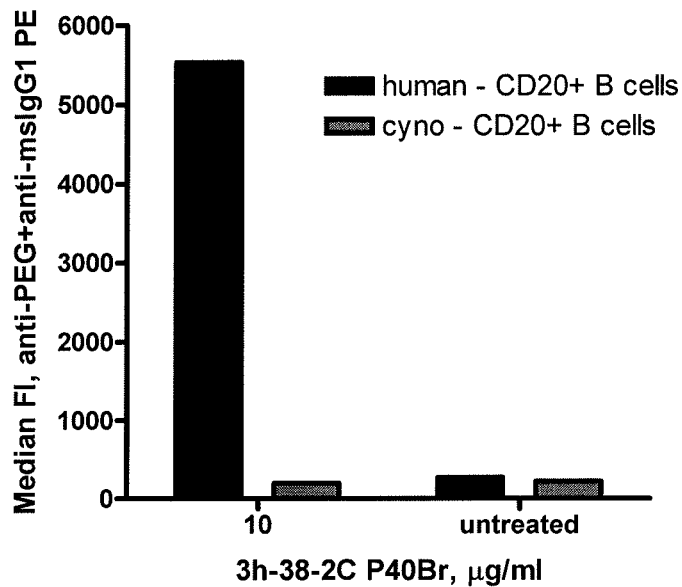
FIG. 3A shows BMS3h38-2C-P40Br binding to human and cynomolgus B cells.
Figure 3B:
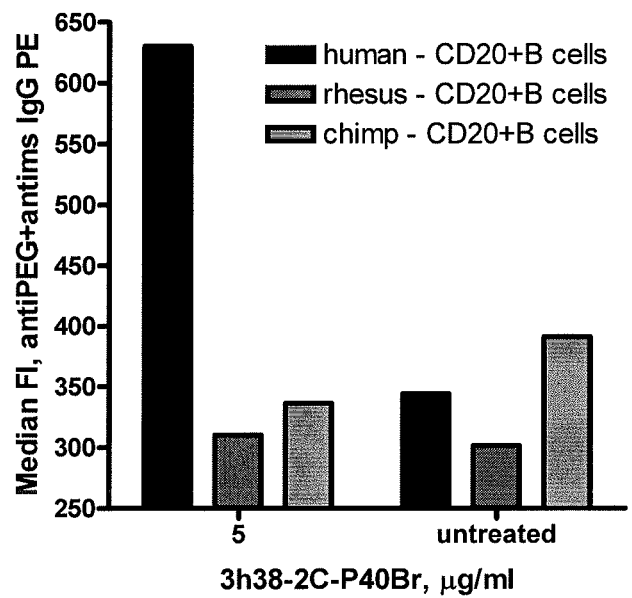
FIG. 3B shows BMS3h38-2C-P40Br binding to human, rhesus, and chimp B cells.

Results:

Binding of PEGylated and biotinylated anti-human CD40 dAbs was tested in human and primate blood samples according to the method above. Anti-human CD40 dAb binding to CD20+ B cells in human blood samples was detected. In contrast, the binding of PEGylated and biotinylated CD40 dAbs was not detected on CD20+ B cells in cynomolgus, rhesus, or chimp blood samples or on lymphocytes in marmoset blood samples. Results for BMS3h-38-2C-P40Br dAb are shown in FIG. 3, Panels A and B. Similar results were obtained for the other dAbs. Comparable levels of CD40 on the B cells of human and primate species were confirmed using an anti-human CD40 antibody that cross reacts with primate CD40. These data indicate that human CD40 dAbs from the BMS3h-56 and BMS3h-38 lineages are unable to bind CD40 in primate species. The data are consistent with the importance of the Trp109 residue in forming a complex between CD40 and the anti-CD40 dAbs, as shown in FIGS. 1 and 2.

Example 10

X-Ray Crystallography of a Complex Between CD40 and dAb BMS3h-56-5

Data Collection and Processing:

Two different crystal forms were analyzed during the structure determination of the human CD40 (SEQ ID NO: 1)/BMS3h-56-5 (SEQ ID NO: 321) complex. Data were collected from a crystal of the CD40/BMS3h56-5 complex, flash-cooled to and maintained at 100 K, and mounted on a Rigaku AFC-9 goniometer. The X-ray source was a Rigaku FR-E using a copper target with MicroMax™ confocal optics and a Saturn 92 detector. Data were collected at extremely high redundancy to enhance the sulfur anomalous diffraction signal in the hopes of using that signal to phase the data. Data were processed with HKL2000 (HKL Research; Otwinowski et al., In *Methods Enzymol. Macromolecular Crystallography* part A, Carter et al., eds., vol. 276, p. 307-326, Academic Press, Inc., New York, N.Y. (1997)). Data collection statistics for this crystal are summarized below and in Table 24:

Space Group: I222;
Unit Cell: a=156.6 Å; b=158.3 Å; c=200.7 Å;
Mosaicity 0.59-0.84; Rejected observations: 1028; 0.06%.

TABLE 24

| s09-167 | Resolution, Å | Measured | Unique | Redun. | % Complete | R value | I/σ$_1$ |
|---|---|---|---|---|---|---|---|
| Overall | 50.00-3.30 | 1603547 | 37772 | 42.5 | 99.8 | 0.137 | 33.7 |
| First Shell | 50.00-8.94 | ≥38193 | 1971 | 40.1 | 97.1 | 0.049 | 58.7 |
| Last Shell | 3.36-3.30 | ≥37054 | 1861 | 43.6 | 99.8 | 0.439 | 12.5 |

A second crystal form was collected from a crystal flash-cooled to 100 K and mounted on a Rayonix MX-225 detector at the Canadian Light Source beamline CMCF1 (08-ID-1) and the wavelength was 0.9793 Å. These data were collected by Shamrock Structures (R. Walter and G. Ranieri) and were processed with HKL2000. Data collection statistics for this crystal are summarized below and in Table 25:

Space Group: C2;
Unit Cell: a=199.3 Å; b=48.7 Å; c=138.8 Å; β=118.2°;
Mosaicity 0.62-0.71; Rejected observations: 70; 0.08%.

TABLE 25

| x09-275 | Resolution, Å | Measured | Unique | Redun. | % Complete | R value | I/σ$_1$ |
|---|---|---|---|---|---|---|---|
| Overall | 50.00-2.80 | 92545 | 29303 | 3.2 | 98.6 | 0.091 | 14.6 |
| First Shell | 50.00-6.03 | 9265 | 3060 | 3.0 | 98.5 | 0.052 | 18.0 |
| Last Shell | 2.90-2.80 | 8857 | 2882 | 3.1 | 98.0 | 0.421 | 3.4 |

Molecular Replacement Models:

The model of the dAb, BMS3h-56-5, was derived from PDB ID 2VYR chain E residues 1-124 with sequential residues corresponding to CDRs 31-35, 50-57, and 99-111 removed by SPLIT_PDB (which corresponds to Kabat numbering 31-35, 50-56, and 95-100G) and then run through MUTATE and finally renumbered by RENUMBER. MUTATE changes non-identical residues to the minimum identical, i.e., normally Ala or Gly, but, for example Tyr→Phe and Phe→Tyr would result in Phe. It does not build any atoms, although for Thr→Val, Val→Thr, Cys→Ser, and Ser→Cys, it will substitute the appropriate atom name, but not change the position. RENUMBER changed the numbering to Kabat numbering (Kabat et al., *Sequences of Immunological Interest*, 5$^{th}$ ed., U.S. Dept. Health & Human Services, Washington, D.C. (1991)), which is a standard numbering system for antibodies that makes description of CDRs and framework residues straight-forward.

A CD40 model was constructed from PDB IDs 1JMA (chain B), 1NCF (chain A), 1TNR (chain R), 2HEV (chain R), 2HEY (chains R, T), and 2UWI (chains A, B) using phenix.ensembler (University of Cambridge, UK) to create an ensemble of structures. The N-termini (residues 24-78) plus a six residue segment (residues 95-100) of these molecules were superimposable with an acceptable root mean square distance for Cα atoms, and that was used as a model for the N-terminal region of CD40.

Molecular Replacement Methods:

The program PHASER (McCoy et al., *J. Appl. Crystallogr.* 40: 658-674 (2007)) was used for molecular replacement. The translation function Z-score (TFZ) and the increase in the log-likelihood gain were monitored to decide whether real solutions had been found. TFZ scores of 8 and above generally represent a solution. Lesser TFZ scores accompanied by substantial increases (>50) in the log-likelihood gain also are acceptable indicators.

Model Building, Density Modification, and Crystallographic Refinement Methods:

Model-building tools for molecular graphics included the COOT program (Emsley et al., *Acta Crystallogr Sect. D* 60: 2126-2132 (2004); Emsley et al., "Features and Development of Coot," *Acta Crystallogr Sect. D* 66: 486-501 (2010)). Density modification using non-crystallographic symmetry map averaging was performed using known density modification programs and other programs to calculate the Eulerian angles and translations between molecules. Refinement was run using autoBUSTER (GlobalPhasing, Ltd.: Bricogne et al., *Acta Crystallogr. Sect. D* 60: 2210-2221 (2004); Tronrud et al., *Acta Crystallogr. Sect. A* 43: 489-501 (1987)).

Domain Antibody Numbering System:

The residue numbering system for the domain antibody follows that of Kabat. The Kabat numbering is compared to straight sequential numbering below for BMS3h-56-5:

```
                      -2-1
                       ||
         BMS-3h-56-5   ST

CDR1
         Kabat                 10       20      30        40        50
                          -    |    -   |   -   |    -    |    -    |
         Sequential            10       20      30        40        50
                          -    |    -   |   -   |    -    |    -    |
         BMS-3h-56-5   EVQLLESGGGLVQPGGSLRLSCAASGFTFRDYEMWWVRQAPGKGLERVSA CDR2
         Kabat              60       70        80            90
                       A -  |    -   |    -    |  ABC    -    |    -
         Sequential         60       70        80            90        100
                          - |    -   |    -    |    -    |    -    |
         BMS-3h-56-5   INPQGTRTYYADSVMGRFTISRDNSKNTLYLQMNSLRAEDTAVYYCAKLP CDR3
         Kabat          99101    110    116
                         ||   -    |   - |
         Sequential           110      119
                          -    |   -    |
         BMS-3h-56-5   FTFDDWGQGTLVTVSSAAA  (SEQ ID NO: 3)
```

In Kabat numbering BMS3h-56-5 has insertion residues 52A, 82A, 82B, 82C and is missing residue 100. In both numbering systems the Ser and Thr at the N-terminus that are part of the expression construct are given negative numbers.

Determination of the Structure of CD40/BMS3h-56-5 Complex:

PHASER was able to locate four BMS3h-56-5 dAb molecules in the I222 crystal form and three BMS3h-56-5 dAb molecules in the C2 crystal form. In the I222 crystal form the TFZ scores ranged from 7.6 to 41.0, and the increase in the log-likelihood gain ranged from 77 to 446. These solutions for the BMS3h-56-5 dAb molecules formed helical columns of dAb molecules through the I222 crystal that were separated from other columns by large channels. In the C2 crystal the TFZ scores ranged from 7.7 to 16.5, and the increase in the log-likelihood gain ranged from 110 to 150. The packing of the dAbs in this crystal form was not repetitive or symmetric.

Using the ensemble model for the CD40 N-terminal domain, four molecules of the N-terminal domain of CD40 could be placed in the I222 crystal form with TFZ scores ranging from 5.7 to 8.5, and the increase in the log-likelihood gain ranged from 83 to 389. The four N-terminal domains of CD40 in the I222 crystal form formed a clump equally centered between four columns of dAb molecules.

the Research Collaboratory for Structural Bioinformatics Protein Data Base was searched for a suitable model to help guide chain tracing. The top two hits with 16 out of 44 identities and 24 out of 44 matches were 2AW2 and 1JMA, which have the same sequence:

```
                                              (SEQ ID NOS 1270-1271)
                 125   130        140       150       160
                  |     |          |         |         |
CD40          CSPGFGVKQIATGVSDTICEPCPVGFFSNVSSAFEKCHPWTSCE
2AW2          CSPGYRVKEACGELTGTVCEPCPPGTYIAHLNGLSKCLQCQMCD
Consensus     CSPG* VK*   ** T CEGCP G *    *  KC       C*
                  |  .    |    .    |    .    |    .    |
                 23      30        40        50       60  66
                  |  .    |    .    |    .    |    .    |
1JMA             19      30        40        50       62
```

Identical residues are noted with the appropriate single letter code on the consensus line and similar residues are noted on the consensus line as asterisks. This was the same stretch of residues as for residues 41-84 of the N-terminal domain of CD40:

```
                                              (SEQ ID NOS 1272 and 1270)
                  41       50        60        70        80
                  |         |         |         |         |
CD40          CQPGQKLVSDCTEFTETECLPCGESEFLDTWNRETHCHQHKYCD
CD40          CSPGFGVKQIATGVSDTICEPCPVGFFSNVSSAFEKCHPWTSCE
Consensus     C PG  *    T  **T C PC    F  *    *   *CH     C*
                  |         |         |         |         |
                 125       130       140       150       160
```

However, they did not touch the BMS3h-56-5 dAb molecules. In the C2 crystal form three molecules of the N-terminal domain of CD40 could be placed with TFZ scores ranging from 5.8 to 12.1, and the increase in the log-likelihood gain ranged from 100 to 198. In this crystal form, the N-terminal domains also did not contact the BMS3h-56-5 dAb molecules.

In the I222 crystal form, the N-terminal domain of the CD40 from the CD40/Chi220 Fab complex and the N-terminal domain from 2UWI were superimposed on the CD40 N-terminal domain. The ability to associate the N-terminal with a particular BMS3h-56-5 dAb allowed the use of non-crystallographic symmetry (NCS) map averaging. The starting correlation coefficients for NCS averaging gave off-diagonal values of 0.71-0.81. The final off-diagonal values were 0.88-0.92. The electron density close to the N-terminal region was clear, and a path could be traced for CDR3 of the BMS3h-56-5 dAb. Residues 82-94 and 101-121 from the CD40/Chi220 Fab' complex were superimposed on the corresponding residues on 2UWI and then COOT was used to improve the fit manually. This position for the second domain (residues 82-94 and 101-121) of CD40 was then transformed onto the other three N-terminal domains.

A cycle of refinement was run with R-free decreasing from 0.437 to 0.380 and R-work from 0.447 to 0.381 with improvement in root mean square bond and angle deviations from ideal. The resulting electron density map showed that residue 109 had a side chain that was consistent with Trp and that density existed for at least some residues in the C-terminal 70 residues of CD40.

Since CD40 has little secondary structure, fitting the C-terminal ~70 residues to the electron proved difficult, so Identical residues are noted with the appropriate single letter code on the consensus line and similar residues are noted on the consensus line as asterisks.
Matching Disulfide Bonds:

| Comparison of Disulfide linkages in residues 41-84 and 125-168 of CD40 | |
|---|---|
| Residues 41-84 | Residues 125-168 |
| C41-C59 | C125-C143 |
| [C38]-C51 | |
| C62-C77 | C146-C161 |
| C83[-C103] | C167[-C186] |

Residues in brackets fall outside of the residue ranges in the sequence repeat.

With the 1JMA/2AW2 model as a guide, the COOT program was used to fit one of the CD40 chains. This fitted model was then superimposed on one of the other three CD40 chains. However, it appeared that the position of this new stretch of residues was differently oriented in the other two CD40 chains, and they were not fitted at this time. A cycle of refinement was run with R-free decreasing from 0.393 to 0.366 and R-work from 0.400 to 0.349 with considerable improvement in root mean square bond and angle deviations from ideal.

The BMS3h-56-5 dAb from one of the molecules in the I222 crystal form was superimposed on each of the three dAbs in the C2 crystal form. That transformation matrix was used to orient the second and C-terminal domains of the I222 crystal form. The model was rebuilt using the COOT program. A cycle of refinement was run with R-free decreasing from 0.361 to 0.334 and R-work from 0.375 to 0.306 with improved root mean square bond and angle deviations from ideal. The resulting electron density map provided guidance for placing many more CD40 residues. Another cycle of refinement was run with R-free decreasing from 0.302 to 0.287 and R-work from 0.299 to 0.270 with improved root mean square bond and angle deviations from ideal Conventional model building and refinement then were used to complete the structure determination. Several more rounds of optimization led to a final refinement with the following statistics: R-free 0.260, R-work 0.228, root mean square bonds 0.010 Å, root mean square angles 1.4°. The real space correlation coefficients are 0.92 for main-chain atoms and 0.80 for side-chain atoms. The final model had 13 water molecules.

Using the model of the C-terminal domain from the C2 crystal form as a guide, the CD40 models in I222 crystal form were further refined. Several more cycles of model building using the COOT program and refinement with the autoBUSTER program led to the following statistics: R-free 0.323, R-work 0.292, root mean square bonds 0.011 Å, root mean square angles 1.5°. The real space correlation coefficients are 0.91 for main-chain atoms and 0.80 for side-chain atoms. The model contained no water molecules.

Overall Structure of the CD40/BMS3h-56-5 Complex:

One BMS3h-56-5 dAb binds to one CD40 molecule. As shown in FIG. 1, BMS3h-56-5 binds to an epitope that is distinct from that of the antibody Chi220, which binds in the N-terminal region. CD40 residues (SEQ ID NO: 1) are shown in green, except for epitope residues. CD40 epitope residues for Chi220 are shown in blue; BMS3h-56-5 dAb epitope residues are shown in cyan. Chi220 Fab and BMS3h-56-5 β-strands are shown in red, CDR residues are shown in magenta, and other loops are shown in orange. Disulfide bonds are shown for the CD40, Chi220, and BMS3h-56-5 molecules with the sulfur atoms in yellow.

The I222 crystal form contains four crystallographically independent CD40/BMS3h-56-5 complexes, and the C2 crystal for contains three crystallographically independent CD40/BMS3h-56-5 complexes. The CD40 molecule has a certain amount of flexibility, and the domains are arrayed differently in the seven unique versions of the complex, but the overall nature of the interaction is retained in all cases.

BMS3h-56-5 dAb Epitope Residues:

The minimal CD40 epitope for BMS3h-56-5 is defined as CD40 residues containing at least one atom in van der Waals or hydrogen-bond contact with a BMS3h-56-5 atom. The minimal epitope in all the complexes contains the following CD40 residues with reference to SEQ ID NO: 1: Trp109, Leu121, His122, Ser124, Ser156, Ala157, Phe158, Glu159, and His162. The following additional residues are in van der Waals or hydrogen-bond contact in some complexes: Pro85, Asn86, Leu87, Gly88, Glu106, Glu107, Gly108, His110, Thr112, Cys119, Val120, Gln133, Ile134, Ala135, Thr136, Ser155, Lys160.

A maximal CD40 epitope is defined as residues containing atoms that are buried by a 1.7 Å probe sphere. These residues include all the residues above, plus Val 154 in all complexes. In some complexes, additional buried residues are: Ser118, Arg123, Thr141, Phe151, Asp153, Cys161, and Pro163.

A depiction of the surface of BMS3h-56-5 with contacting residues is shown in FIG. 2. Contacting BMS3h-56-5 residues are shown. Buried residues are also shown. CD40 is represented as a cartoon with orange representing non-repetitive secondary structure and magenta representing the epitope residues. Also shown as sticks (carbon atoms in cyan) are CD40 residues Trp109, Ala115, Leu121, Ser126, and His162, which are five of the seven residues that differ between human and cynomolgus monkey (*Macaca fascicularis*). Ala115 and Ser126 are on the opposite side of CD40 from the BMS3h-56-5 binding site. Trp109 and Leu121 bind in a cleft of BMS-h-56-5 that lies between CDR-3 and FR-2 (BMS-3h-56-5 residues Leu45 and Arg47). His162 of CD40 interacts with Arg56 of CDR-2 of the BMS3h-56-5 dAb. Mutation of Trp109 considerably reduces or ablates BMS3h-56-5 activity.

Depending on the crystallographically independent complex, 660-740 Å$^2$ of CD40 surface area is buried with between 16-21 contacting residues represented at a finer level with contacting 46-67 atoms. For BMS3h-56-5, 660-780 Å$^2$ of surface area is buried with contacting 14-17 residues represented at a finer level with contacting 48-62 atoms. These contacts yield 3-7 hydrogen bonds and 111-142 van der Waals interactions, depending on the crystallographically independent complex.

Example 11

Identifying dAb Binding Epitopes on CD40

To identify dAb binding epitopes on CD40, dAb binding was tested against seven CD40-Fc fusion proteins containing specific amino acid residue substitutions at residues 76, 109, or 121. These CD40-Fc fusion proteins include wild type human CD40 (wt-hCD40), wild type cynomolgus monkey CD40 (wt-cCD40), and five mutant human CD40 proteins (M1-M5) with specific amino acid residues mutated to the corresponding residue from the sequence of cynomolgus monkey CD40 (M1, M2, M4, M5) or chimpanzee CD40 (M3). The amino acid substitutions are listed in Table 26.

The sequence of the wild type human CD40 extracellular domain (1-193) is from REFSEQ:accession NM_001250.3. Cynomolgous and mutant constructs were generated using site-directed mutagenesis of the wild type sequence at the positions shown in Table 26. The extracellular domains were fused with a thrombin-cleavable linker DPGGGGGR-LVPRGFGTGDP (SEQ ID NO: 1273), which was fused with human IgG1 Fc. The proteins were expressed in HEK-293-6E cells transfected with TIG-pYD7-GATE Durocher expression vectors. The supernatants were harvested after five days. Each CD40 protein was purified from conditioned media using protein A fast flow chromatography. The column was washed with PBS (20 mM sodium phosphate, 0.15 M NaCl, pH 7.2) and then eluted using 80 mM sodium acetate, pH 3, into ⅕$^{th}$ volume of 1 M Tris-HCl, pH 8. The eluate was run on a Superdex-200 column in PBS.

TABLE 26

| Name | Short name | Residue 76 | Residue 109 | Residue 121 |
|---|---|---|---|---|
| wild type human CD40 Fc fusion | wt-hCD40 | H | W | L |
| human CD40 (H76R) Fc fusion | hCD40-M1 | R | W | L |
| human CD40 (W109L) Fc fusion | hCD40-M2 | H | L | L |
| human CD40 (W109R) Fc fusion (Chimpanzee CD40) | hCD40-M3 | H | R | L |
| human CD40 (W109L, L121P) Fc fusion | hCD40-M4 | H | L | P |
| human CD40 (H76R, W109L, L121P) Fc fusion | hCD40-M5 | R | L | P |
| wild type cynomolgus monkey CD40 Fe fusion | wt-cyno-CD40 | R | L | P |

Representative dAb's from the 3h217, 3h37, 3h38, and 3h56 lineages were assayed for their binding to CD40-Fc fusion proteins listed in Table 26. Assays were performed on a BioRad ProteOn XPR36SPR instrument. The SPR surfaces were prepared by immobilizing 8 µg/ml anti-human IgG(Fc) antibody (Biacore/GE Healthcare) in 10 mM sodium acetate pH 4.5 on a BioRad GLC sensor chip using standard ethyl(dimethylaminopropyl) carbodiimide (EDC)/ N-hydroxysuccinimide (NHS) chemistry, with ethanolamine blocking. The running buffer for immobilization and kinetic binding analysis was 10 mM sodium phosphate, 130 mM sodium chloride, 0.05% tween 20, pH 7.1. CD40-Fc fusion proteins at concentrations of 20 µg/ml were captured in the vertical orientation on these surfaces via the Fc tail, and reference surfaces lacking CD40-Fc proteins were used for reference subtraction. Kinetic experiments were performed by flowing 405, 135, 45, 15, and 5 nM dAb analytes in the horizontal orientation over the captured CD40-Fc surfaces at 25° C., using a 240 s association time, and a 420 s dissociation time, at a flow rate of 30 µl/min. The surfaces were regenerated in both horizontal and vertical orientations with 30 s pulses of 3 M $MgCl_2$ followed by running buffer at 60 µl/min. Sensogram data was double-referenced and then fitted to a 1:1 Langmuir model using BioRad ProteOn Manager V.2.1.0.38 software, to determine the association rate constant (ka), the dissociation rate constant (kd), and the equilibrium dissociation constant ($K_D$).

All dAbs of the 3h-37, 3h-38, and 3h-56 lineages were found to bind with high affinity ($K_D < 10^{-8}$ M) to CD40-Fc fusion proteins containing the human CD40 residues W109 and L121, but binding was significantly reduced or undetectable to CD40-Fc fusion proteins with the corresponding residues from cynomolgus monkey CD40 (L109, P121) or chimpanzee CD40 (R109). This indicates that dAbs from each of the 3h37, 3h38-, and 3h56-lineages bind specifically to an epitope that includes residues 109 and 121 of human CD40. In contrast, all tested members of the 3h-217 lineage bound with similar affinity to all CD40-Fc fusion proteins tested, indicating that the members of the 3h-217 lineage bind to a site on CD40 which does not include residues 76, 109, or 121. Therefore, the 3h-217 lineage binds to a different epitope than the 3h-37, 3h-38, and 3h-56 lineages. Table 27 summarizes $K_D$ values determined for dAb binding to CD40-Fc fusion proteins using SPR on a ProteOn XPR36 instrument. An "X" in Table 27 means that no evidence for binding was found under these conditions.

TABLE 27

| | wt-hCD40 | hCD40-M1 (H76R) | hCD40-M2 (W109L) | hCD40-M3 (W109R) | hCD40-M4 (W109L, L121P) | hCD40-M5 (H76R, W109L, L121P) | cyno CD40 |
|---|---|---|---|---|---|---|---|
| 3h-217-5 | 0.47, 0.48 | 0.94 | 0.99 | 0.72 | 0.93 | 1.0 | 0.9 |
| 3h-217-16 | 0.22, 0.26 | 0.35 | 0.41 | 0.27 | 0.35 | 0.5 | 0.4 |
| 3h-217-23 | 0.78, 1.5 | 1.6 | 2.0 | 1.2 | 1.6 | 2.2 | 1.9 |
| 3h-37-2 | 2.0, 2.0 | 2.6 | >1000 | X | X | X | X |
| 3h-37-11 | 1.9, 2.3 | 2.4 | >1000 | X | X | X | X |
| 3h-38-2 | 5.1, 8.0 | 7.2 | X | X | X | X | X |
| 3h-38-211 | 3.3, 6.1 | 4.0 | >1000 | X | X | X | X |
| 3h-38-215 | 2.1, 6.0 | 3.0 | >1000 | X | X | X | X |
| 3h-38-217 | 2.3, 2.4 | 3.4 | >1000 | X | X | X | X |
| 3h-56-1 | 3.0, 5.4 | 4.2 | 29 | >1000 | X | X | X |
| 3h-56-2 | 3.8, 3.2 | 6.1 | 44 | >1000 | X | X | X |
| 3h-56-5 | 5.3, 4.7 | 7.2 | 65 | >1000 | X | X | X |
| 3h-56-202 | 2.3, 1.3 | 3.3 | 160 | X | X | X | X |
| 3h-56-206 | 0.60, 1.4 | 1.0 | 55 | X | X | X | X |
| 3h-56-217 | 1.0, 1.9 | 1.4 | 2.5 | 23 | X | X | X |

Table 28 shows the association rate constant (ka), dissociation rate constant (kd), and equilibrium dissociation constant ($K_D$) determined for dAb binding to CD40-Fc fusion proteins using SPR on a ProteOn XPR36 instrument. An "X" in Table 28 means that no evidence for binding was found under these conditions.

TABLE 28

| Ligand | dAb | ka (1/Ms) | kd (1/s) | Kd (nM) |
|---|---|---|---|---|
| wt-hCD40 | 3h-217-5 | $2.71 \times 10^6$ | $1.27 \times 10^{-3}$ | 0.47 |
| wt-hCD40 (repeat) | 3h-217-5 | $2.03 \times 10^6$ | $9.81 \times 10^{-4}$ | 0.48 |
| hCD40 M1 (H76R) | 3h-217-5 | $3.17 \times 10^6$ | $2.99 \times 10^{-3}$ | 0.94 |
| hCD40 M2 (W109L) | 3h-217-5 | $2.55 \times 10^6$ | $2.51 \times 10^{-3}$ | 0.99 |
| hCD40 M3 (W109R) | 3h-217-5 | $2.73 \times 10^6$ | $1.96 \times 10^{-3}$ | 0.72 |
| hCD40 M4 (W109L, L121P) | 3h-217-5 | $2.78 \times 10^6$ | $2.59 \times 10^{-3}$ | 0.93 |
| hCD40-M5 (H76R, W109L, L121P) | 3h-217-5 | $2.44 \times 10^6$ | $2.42 \times 10^{-3}$ | 0.99 |
| wt-cCD40 | 3h-217-5 | $2.46 \times 10^6$ | $2.12 \times 10^{-3}$ | 0.86 |
| wt-hCD40 | 3h-217-16 | $4.47 \times 10^6$ | $9.91 \times 10^{-4}$ | 0.22 |
| wt-hCD40 (repeat) | 3h-217-16 | $3.30 \times 10^6$ | $8.47 \times 10^{-4}$ | 0.26 |
| hCD40 M1 (H76R) | 3h-217-16 | $4.83 \times 10^6$ | $1.68 \times 10^{-3}$ | 0.35 |
| hCD40 M2 (W109L) | 3h-217-16 | $4.06 \times 10^6$ | $1.67 \times 10^{-3}$ | 0.41 |
| hCD40 M3 (W109R) | 3h-217-16 | $3.78 \times 10^6$ | $1.04 \times 10^{-3}$ | 0.27 |
| hCD40 M4 (W109L, L121P) | 3h-217-16 | $4.39 \times 10^6$ | $1.52 \times 10^{-3}$ | 0.35 |
| hCD40-M5 (H76R, W109L, L121P) | 3h-217-16 | $3.65 \times 10^6$ | $1.70 \times 10^{-3}$ | 0.47 |
| wt-cCD40 | 3h-217-16 | $3.44 \times 10^6$ | $1.47 \times 10^{-3}$ | 0.43 |
| wt-hCD40 | 3h-217-23 | $1.64 \times 10^6$ | $1.27 \times 10^{-3}$ | 0.78 |
| wt-hCD40 (repeat) | 3h-217-23 | $1.07 \times 10^6$ | $1.63 \times 10^{-3}$ | 1.52 |
| hCD40 M1 (H76R) | 3h-217-23 | $1.64 \times 10^6$ | $2.62 \times 10^{-3}$ | 1.59 |
| hCD40 M2 (W109L) | 3h-217-23 | $1.49 \times 10^6$ | $2.91 \times 10^{-3}$ | 1.95 |
| hCD40 M3 (W109R) | 3h-217-23 | $1.53 \times 10^6$ | $1.86 \times 10^{-3}$ | 1.22 |
| hCD40 M4 (W109L, L121P) | 3h-217-23 | $1.67 \times 10^6$ | $2.68 \times 10^{-3}$ | 1.61 |
| hCD40-M5 (H76R, W109L, L121P) | 3h-217-23 | $1.30 \times 10^6$ | $2.87 \times 10^{-3}$ | 2.21 |
| wt-cCD40 | 3h-217-23 | $1.24 \times 10^6$ | $2.35 \times 10^{-3}$ | 1.90 |
| wt-hCD40 | 3h-37-2 | $2.12 \times 10^5$ | $4.17 \times 10^{-4}$ | 1.96 |
| wt-hCD40 (repeat) | 3h-37-2 | $2.13 \times 10^5$ | $4.26 \times 10^{-4}$ | 2.00 |
| hCD40 M1 (H76R) | 3h-37-2 | $2.17 \times 10^5$ | $5.62 \times 10^{-4}$ | 2.58 |
| hCD40 M2 (W109L) | 3h-37-2 | | | >1000 |
| hCD40 M3 (W109R) | 3h-37-2 | | | X |
| hCD40 M4 (W109L, L121P) | 3h-37-2 | | | X |
| hCD40-M5 (H76R, W109L, L121P) | 3h-37-2 | | | X |
| wt-cCD40 | 3h-37-2 | | | X |
| wt-hCD40 | 3h-37-11 | $2.91 \times 10^5$ | $5.60 \times 10^{-4}$ | 1.92 |
| wt-hCD40 (repeat) | 3h-37-11 | $2.81 \times 10^5$ | $6.40 \times 10^{-4}$ | 2.28 |
| hCD40 M1 (H76R) | 3h-37-11 | $3.00 \times 10^5$ | $7.17 \times 10^{-4}$ | 2.39 |
| hCD40 M2 (W109L) | 3h-37-11 | | | >1000 |
| hCD40 M3 (W109R) | 3h-37-11 | | | X |
| hCD40 M4 (W109L, L121P) | 3h-37-11 | | | X |
| hCD40-M5 (H76R, W109L, L121P) | 3h-37-11 | | | X |
| wt-cCD40 | 3h-37-11 | | | X |
| wt-hCD40 | 3h-38-2 | $1.20 \times 10^5$ | $6.08 \times 10^{-4}$ | 5.07 |
| wt-hCD40 (repeat) | 3h-38-2 | $1.42 \times 10^5$ | $1.14 \times 10^{-3}$ | 8.04 |
| hCD40 M1 (H76R) | 3h-38-2 | $1.40 \times 10^5$ | $1.00 \times 10^{-3}$ | 7.15 |
| hCD40 M2 (W109L) | 3h-38-2 | | | X |
| hCD40 M3 (W109R) | 3h-38-2 | | | X |
| hCD40 M4 (W109L, L121P) | 3h-38-2 | | | X |
| hCD40-M5 (H76R, W109L, L121P) | 3h-38-2 | | | X |
| wt-cCD40 | 3h-38-2 | | | X |
| wt-hCD40 | 3h-38-211 | $1.11 \times 10^5$ | $3.62 \times 10^{-4}$ | 3.26 |
| wt-hCD40 (repeat) | 3h-38-211 | $1.20 \times 10^5$ | $7.28 \times 10^{-4}$ | 6.08 |
| hCD40 M1 (H76R) | 3h-38-211 | $1.28 \times 10^5$ | $5.10 \times 10^{-4}$ | 3.98 |
| hCD40 M2 (W109L) | 3h-38-211 | | | >1000 |
| hCD40 M3 (W109R) | 3h-38-211 | | | X |
| hCD40 M4 (W109L, L121P) | 3h-38-211 | | | X |
| hCD40-M5 (H76R, W109L, L121P) | 3h-38-211 | | | X |
| wt-cCD40 | 3h-38-211 | | | X |
| wt-hCD40 | 3h-38-215 | $1.37 \times 10^5$ | $2.88 \times 10^{-4}$ | 2.10 |
| wt-hCD40 (repeat) | 3h-38-215 | $1.36 \times 10^5$ | $8.20 \times 10^{-4}$ | 6.02 |
| hCD40 M1 (H76R) | 3h-38-215 | $1.75 \times 10^5$ | $5.30 \times 10^{-4}$ | 3.03 |
| hCD40 M2 (W109L) | 3h-38-215 | | | >1000 |
| hCD40 M3 (W109R) | 3h-38-215 | | | X |
| hCD40 M4 (W109L, L121P) | 3h-38-215 | | | X |
| hCD40-M5 (H76R, W109L, L121P) | 3h-38-215 | | | X |
| wt-cCD40 | 3h-38-215 | | | X |
| wt-hCD40 | 3h-38-217 | $1.27 \times 10^5$ | $2.96 \times 10^{-4}$ | 2.34 |
| wt-hCD40 (repeat) | 3h-38-217 | $1.44 \times 10^5$ | $3.40 \times 10^{-4}$ | 2.37 |
| hCD40 M1 (H76R) | 3h-38-217 | $1.41 \times 10^5$ | $4.81 \times 10^{-4}$ | 3.41 |
| hCD40 M2 (W109L) | 3h-38-217 | | | >1000 |
| hCD40 M3 (W109R) | 3h-38-217 | | | X |
| hCD40 M4 (W109L, L121P) | 3h-38-217 | | | X |
| hCD40-M5 (H76R, W109L, L121P) | 3h-38-217 | | | X |
| wt-cCD40 | 3h-38-217 | | | X |
| wt-hCD40 | 3h-56-1 | $2.52 \times 10^5$ | $7.50 \times 10^{-4}$ | 2.97 |
| wt-hCD40 (repeat) | 3h-56-1 | $1.93 \times 10^5$ | $1.03 \times 10^{-3}$ | 5.35 |
| hCD40 M1 (H76R) | 3h-56-1 | $2.31 \times 10^5$ | $9.67 \times 10^{-4}$ | 4.18 |
| hCD40 M2 (W109L) | 3h-56-1 | $1.92 \times 10^5$ | $5.57 \times 10^{-3}$ | 29.10 |
| hCD40 M3 (W109R) | 3h-56-1 | | | >1000 |

TABLE 28-continued

| Ligand | dAb | ka (1/Ms) | kd (1/s) | Kd (nM) |
|---|---|---|---|---|
| hCD40 M4 (W109L, L121P) | 3h-56-1 | | | X |
| hCD40-M5 (H76R, W109L, L121P) | 3h-56-1 | | | X |
| wt-cCD40 | 3h-56-1 | | | X |
| wt-hCD40 | 3h-56-2 | $2.46 \times 10^5$ | $9.27 \times 10^{-4}$ | 3.77 |
| wt-hCD40 (repeat) | 3h-56-2 | $1.97 \times 10^5$ | $6.24 \times 10^{-4}$ | 3.17 |
| hCD40 M1 (H76R) | 3h-56-2 | $2.20 \times 10^5$ | $1.33 \times 10^{-3}$ | 6.05 |
| hCD40 M2 (W109L) | 3h-56-2 | $1.89 \times 10^5$ | $8.30 \times 10^{-3}$ | 43.90 |
| hCD40 M3 (W109R) | 3h-56-2 | | | >1000 |
| hCD40 M4 (W109L, L121P) | 3h-56-2 | | | X |
| hCD40-M5 (H76R, W109L, L121P) | 3h-56-2 | | | X |
| wt-cCD40 | 3h-56-2 | | | X |
| wt-hCD40 | 3h-56-5 | $1.78 \times 10^5$ | $9.38 \times 10^{-4}$ | 5.26 |
| wt-hCD40 (repeat) | 3h-56-5 | $1.53 \times 10^5$ | $7.19 \times 10^{-4}$ | 4.69 |
| hCD40 M1 (H76R) | 3h-56-5 | $1.69 \times 10^5$ | $1.21 \times 10^{-3}$ | 7.18 |
| hCD40 M2 (W109L) | 3h-56-5 | $1.38 \times 10^5$ | $8.89 \times 10^{-3}$ | 64.60 |
| hCD40 M3 (W109R) | 3h-56-5 | | | >1000 |
| hCD40 M4 (W109L, L121P) | 3h-56-5 | | | X |
| hCD40-M5 (H76R, W109L, L121P) | 3h-56-5 | | | X |
| wt-cCD40 | 3h-56-5 | | | X |
| wt-hCD40 | 3h-56-202 | 1.82E+05 | $4.15 \times 10^{-4}$ | 2.27 |
| wt-hCD40 (repeat) | 3h-56-202 | 1.77E+05 | $2.21 \times 10^{-4}$ | 1.25 |
| hCD40 M1 (H76R) | 3h-56-202 | 1.76E+05 | $5.79 \times 10^{-4}$ | 3.29 |
| hCD40 M2 (W109L) | 3h-56-202 | 1.35E+05 | $2.00 \times 10^{-2}$ | 155.00 |
| hCD40 M3 (W109R) | 3h-56-202 | | | X |
| hCD40 M4 (W109L, L121P) | 3h-56-202 | | | X |
| hCD40-M5 (H76R, W109L, L121P) | 3h-56-202 | | | X |
| wt-cCD40 | 3h-56-202 | | | X |
| wt-hCD40 | 3h-56-206 | 6.48E+05 | $3.89 \times 10^{-4}$ | 0.60 |
| wt-hCD40 (repeat) | 3h-56-206 | 3.27E+05 | $4.72 \times 10^{-4}$ | 1.44 |
| hCD40 M1 (H76R) | 3h-56-206 | 5.65E+05 | $5.45 \times 10^{-4}$ | 0.96 |
| hCD40 M2 (W109L) | 3h-56-206 | 3.38E+05 | $2.00 \times 10^{-2}$ | 54.70 |
| hCD40 M3 (W109R) | 3h-56-206 | | | X |
| hCD40 M4 (W109L, L121P) | 3h-56-206 | | | X |
| hCD40-M5 (H76R, W109L, L121P) | 3h-56-206 | | | X |
| wt-cCD40 | 3h-56-206 | | | X |
| wt-hCD40 | 3h-56-217 | 4.71E+05 | $4.70 \times 10^{-4}$ | 1.00 |
| wt-hCD40 (repeat) | 3h-56-217 | 2.91E+05 | $5.46 \times 10^{-4}$ | 1.87 |
| hCD40 M1 (H76R) | 3h-56-217 | 4.45E+05 | $6.35 \times 10^{-4}$ | 1.43 |
| hCD40 M2 (W109L) | 3h-56-217 | 4.25E+05 | $1.05 \times 10^{-3}$ | 2.48 |
| hCD40 M3 (W109R) | 3h-56-217 | 2.91E+05 | $6.70 \times 10^{-3}$ | 23.00 |
| hCD40 M4 (W109L, L121P) | 3h-56-217 | | | X |
| hCD40-M5 (H76R, W109L, L121P) | 3h-56-217 | | | X |
| wt-cCD40 | 3h-56-217 | | | X |

Example 12

Construction of Fc Fusion Polypeptides

Antibody polypeptides comprising dAbs can be constructed in various configurations, as disclosed herein. In this example, various dAbs were fused with a Fc domain to generate Fc fusion polypeptides of anti-human CD40 variable domain constructs such as 3h37-202, 3h37-235, 3h37-258, and 3h37-202.

In one representative example, the dAb BMS3h-56-269 (SEQ ID NO: 417) was fused with a modified IgG1 (IgG1*) Fc domain (SEQ ID NO: 1284). In the dAb-IgG1*Fc domain fusion polypeptide, the C-terminus of dAb BMS3h-56-269 was fused to a linker tripeptide having the sequence Ala-Ser-Thr, which in turn was fused with the IgG1*Fc domain (SEQ ID NO: 1284). The IgG1*Fc domain contained the modification C5S, referring to the numbering of positions in SEQ ID NO: 1284. C5 of the IgG1 Fc domain normally forms a disulfide bond with a Cys residue in the light chain of an IgG molecule. The IgG1*Fc domain also contained C11S and C14S mutations to eliminate interchain disulfide bonds in the IgG1 hinge region. Finally, the IgG1*Fc domain contained a P23S mutation to lower Fc domain effector function. The dAb-IgG1*Fc fusion polypeptide has the following sequence, where the Ala-Ser-Thr linker is in bold font and the modifications to the Fc domain are in bold italics:

```
                                          (SEQ ID NO: 1286)
  1 EVQLLESGGG LVQPGGSLRL SCAASGFTFR DYEMWWVRQA
    PGKGLERVSA

51 INPQGTRTYY ADSVKGRFTI SRDNSKNTLY LQMNSLRAED
    TAVYYCAKLP

101 FRFSDRGQGT LVTVSSASTE PKS*S*DKTHT*S* PP*S*PAPELLG
    G*S*SVFLFPPK

151 PKDTLMISRT PEVTCVVVDV SHEDPEVKFN WYVDGVEVHN
    AKTKPREEQY

201 NSTYRVVSVL TVLHQDWLNG KEYKCKVSNK ALPAPIEKTI
    SKAKGQPREP

251 QVYTLPPSRD ELTKNQVSLT CLVKGFYPSD IAVEWESNGQ
    PENNYKTTPP

301 VLDSDGSFFL YSKLTVDKSR WQQGNVFSCS VMHEALHNHY
    TQKSLSLSPG

351 K
```

The dAb-IgG1*Fc fusion polypeptide depicted in SEQ ID NO: 1286 is a monomer having a calculated molecular weight of 39,127 Da. It can form a dimer having a calculated molecular weight of 78,254 Da.

dAb BMS3h-56-269 (SEQ ID NO: 417) alternatively was fused with a human IgG$_4$ Fc domain (SEQ ID NO: 1285). The C-terminus of dAb BMS3h-56-269 was again fused to the Ala-Ser-Thr linker, which was fused with the IgG$_4$ Fc domain (SEQ ID NO: 1285). The IgG$_4$ Fc domain contained the modification S10P, referring to the numbering of positions in SEQ ID NO: 1285. The BMS3h-56-269-IgG$_4$ Fc fusion polypeptide has the following sequence, where the Ala-Ser-Thr linker is in bold font and the S10P modification is in bold italics:

```
                                            (SEQ ID NO: 1287)
  1 EVQLLESGGG LVQPGGSLRL SCAASGFTFR DYEMWWVRQA
    PGKGLERVSA

51 INPQGTRTYY ADSVKGRFTI SRDNSKNTLY LQMNSLRAED
    TAVYYCAKLP

101 FRFSDRGQGT LVTVSSASTE SKYGPPCPPC PAPEFLGGPS
    VFLFPPKPKD

151 TLMISRTPEV TCVVVDVSQE DPEVQFNWYV DGVEVHNAKT
    KPREEQFNST

201 YRVVSVLTVL HQDWLNGKEY KCKVSNKGLP SSIEKTISKA
    KGQPREPQVY

251 TLPPSQEEMT KNQVSLTCLV KGFYPSDIAV EWESNGQPEN
    NYKTTPPVLD

301 SDGSFFLYSR LTVDKSRWQE GNVFSCSVMH EALHNHYTQK
    SLSLSLGK
```

The BMS3h-56-269-IgG4 Fc fusion polypeptide depicted in SEQ ID NO: 1287 is a monomer having a calculated molecular weight of 38,867 Da. It can form a dimer having a calculated molecular weight of 77,734 Da.

The sequences of BMS3h-56-269 (SEQ ID NO: 417), BMS3h-56-269-IgG1*Fc fusion polypeptide (SEQ ID NO: 1286), and BMS3h-56-269-IgG$_4$ Fc fusion polypeptide (SEQ ID NO: 1287) are aligned below, where the start of the Fc domain is marked by an arrow:

```
BMS3h56-269 (SEQ ID NO: 417) (1)
EVQLLESGGGLVQPGGSLRLSCAASGFTFRDYEMWWVRQAPGKGLERVSA
BMS3h56-269-CTL2 (SEQ ID NO: 1286) (1)
EVQLLESGGGLVQPGGSLRLSCAASGFTFRDYEMWWVRQAPGKGLERVSA
BMS3h56-269-Ig4 (SEQ ID NO: 1287) (1)
EVQLLESGGGLVQPGGSLRLSCAASGFTFRDYEMWWVRQAPGKGLERVSA

BMS3h56-269 (SEQ ID NO: 417) (34)
INPQGTRTYYADSVKGRFTISRDNSKNTLYLQMNSLRAEDTAVYYCAKLP
BMS3h56-269-CTL2 (SEQ ID NO: 1286) (51)
INPQGTRTYYADSVKGRFTISRDNSKNTLYLQMNSLRAEDTAVYYCAKLP
BMS3h56-269-Ig4 (SEQ ID NO: 1287) (51)
INPQGTRTYYADSVKGRFTISRDNSKNTLYLQMNSLRAEDTAVYYCAKLP

BMS3h56-269 (SEQ ID NO: 417) (84)
FRFSDRGQGTLVTVSS----------------------------------
BMS3h56-269-CTL2 (SEQ ID NO: 1286) (101)
FRFSDRGQGTLVTVSSASTEPKSSDKTHTSPPSPAPELLGGSSVFLFPPK
BMS3h56-269-Ig4 (SEQ ID NO: 1287) (101)
FRFSDRGQGTLVTVSSASTESKYG---PPCPPCPAPEFLGGPSVFLFPPK
                ↑
             Start of Fc
```

```
BMS3h56-269 (SEQ ID NO: 417) (117)
--------------------------------------------------
BMS3h56-269-CTL2 (SEQ ID NO: 1286) (151)
PKDTLMISRTPEVTCVVVDVSHEDPEVKFNWYVDGVEVHNAKTKPREEQY
BMS3h56-269-Ig4 (SEQ ID NO: 1287) (148)
PKDTLMISRTPEVTCVVVDVSQEDPEVQFNWYVDGVEVHNAKTKPREEQF

BMS3h56-269 (SEQ ID NO: 417) (117)
--------------------------------------------------
BMS3h56-269-CTL2 (SEQ ID NO: 1286) (201)
NSTYRVVSVLTVLHQDWLNGKEYKCKVSNKALPAPIEKTISKAKGQPREP
BMS3h56-269-Ig4 (SEQ ID NO: 1287) (198)
NSTYRVVSVLTVLHQDWLNGKEYKCKVSNKGLPSSIEKTISKAKGQPREP

BMS3h56-269 (SEQ ID NO: 417) (117)
--------------------------------------------------
BMS3h56-269-CTL2 (SEQ ID NO: 1286) (251)
QVYTLPPSRDELTKNQVSLTCLVKGFYPSDIAVEWESNGQPENNYKTTPP
BMS3h56-269-Ig4 (SEQ ID NO: 1287) (248)
QVYTLPPSQEEMTKNQVSLTCLVKGFYPSDIAVEWESNGQPENNYKTTPP

BMS3h56-269 (SEQ ID NO: 417) (117)
--------------------------------------------------
BMS3h56-269-CTL2 (SEQ ID NO: 1286) (301)
VLDSDGSFFLYSKLTVDKSRWQQGNVFSCSVMHEALHNHYTQKSLSLSPG
BMS3h56-269-Ig4 (SEQ ID NO: 1287) (298)
VLDSDGSFFLYSRLTVDKSRWQEGNVFSCSVMHEALHNHYTQKSLSLSLG

BMS3h56-269 (SEQ ID NO: 417) (117) -
BMS3h56-269-CTL2 (SEQ ID NO: 1286) (351) K
BMS3h56-269-Ig4 (SEQ ID NO: 1287) (348) K
```

The Fc fusion polypeptides were expressed using the cell culture methods disclosed in Example 11. The column was washed with PBS (20 mM sodium phosphate, 0.15 M NaCl, pH 7.2) and then eluted using 80 mM sodium acetate, pH 3, into $\frac{1}{5}^{th}$ volume of 1 M Tris-HCl, pH 8. The eluate was run on a Superdex-200 column in PBS.

Example 13

CD40 Fc Fusion Polypeptide Activity Assays

Anti-human CD40 Fc Fusion Polypeptides were assayed functionally for their ability to antagonize CD40 activities. The CD40 activities tested were B cell proliferation and cytokine production by hCD40L-driven activation of primary human monocyte-derived dendritic cells (DCs). B cell proliferation and cytokine production were measured using the assays disclosed in Example 6. Unless otherwise noted, all assays were performed in RPMI media supplemented with 10% fetal calf serum (FCS). The dAb-Fc domain fusion polypeptides exhibited potent inhibition (i.e., antagonism) of CD40-dependent activation. There were no agonistic properties noted among any of the humanCD40-specific dAb-Fc domain fusion polypeptides. The results using the various assays are shown in TABLE 29. 3h56-269-IgG4 was assayed for its binding to immobilized human-CD40 using the assays disclosed in Example 11. For 3h56-269-IgG4, the apparent avidity influenced Kd value for binding immobilized human-CD40 is measured at 30 pM at 25 C and 40 pM at 37 C.

TABLE 29

| dAb-Fc | hIZCD40L-driven Human B Cell Proliferation EC50 (nM) | CHO-hCD40L-driven Human B Cell Proliferation EC50 (nM) | T-B cell MLR EC50 (nM) | CHO-hCD40L-driven DC Activation TNF EC50 (nM) | CHO-hCD40L-driven DC Activation IL-6 EC50 (nM) | CHO-hCD40L-driven DC Activation IL-12 EC50 (nM) |
|---|---|---|---|---|---|---|
| 3h37-202-IgG4 | 0.16 ± 0.08 | 5.0, 3.0 | 5.0, 6.0 | | | 0.53 ± 0.1 |
| 3h37-202-IgG1* | 0.27, 0.22 | 3.0, 7.0 | | | | 0.74 ± 0.2 |
| 3h38-235-IgG4 | 0.20, 0.15 | 6.0, 10.0 | 16.7 ± 5.7 | | | 0.67 ± 0.3 |
| 3h38-235-IgG1* | 0.25 ± 0.1 | 4.0 ± 1.0 | | | | 0.88 ± 0.3 |
| 3h56-258-IgG4 | 0.16 ± 0.05 | 1.0 ± 0.8 | 2.4 ± 0.99 | 0.22 ± 0.08 | 0.11 ± 0.05 | 0.3 ± 0.2 |
| 3h56-258-IgG1* | 0.063 ± 0.03 | 0.6 ± 0.4 | 2.0 ± 0.63 | | | 0.31 ± 0.1 |
| 3h56-269-IgG4 | 0.028 ± 0.01 | 0.27 ± 0.08 | 0.52 ± 0.07 | 0.16 ± 0.03 | 0.09 ± 0.02 | 0.092 ± 0.03 |
| 3h56-269-IgG1* | 0.025 ± 0.01 | 0.25 ± 0.04 | 0.53 ± 0.1 | 0.27 ± 0.06 | 0.15 ± 0.05 | 0.14 ± 0.06 |

Although the present embodiments have been described in detail with reference to examples above, it is understood that various modifications can be made without departing from the spirit of these embodiments, and would be readily known to the skilled artisan.

SEQUENCE LISTING (1287 sequences)

SEQ ID NO: 1 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 2 - protein, 278 aa, Macaca fascicularis
MVRLPLQCVLWGCLLTAVYPEPPTACREKQYLINSQCCSLCQPGQKLVSDCTEFTETECLPCGESEFLDTWNRETRCHQHKYCDPNLGLRVQQKGTSETDTICTCEEGLHCTSESCESCVPHRSCLPGFGVKQIATGVSDTICEPCPVGFFSNVSSAFEKCRPWTSCETKDLVVQQAGTNKTDVVCGPQDRQRALVVIPICLGILFVILLLVLVFIKKVAKKPNDKVPHPKQEPQEINFPDDLPGSNPAAPVQETLHGCQPVTQEDGKESRISVQERQ

SEQ ID NO: 3 - protein, 119 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYYCAKLPFTFDDWGQGTLVTVSSAAA

SEQ ID NO: 4 - protein, 25 aa, Artificial Sequence
  Description of Artificial Sequence: Synthetic peptide
  misc_feature (1)..(25): This sequence may encompass 1 to 5 "Gly Gly Gly Gly Ser" repeating units
GGGGSGGGGSGGGGSGGGGSGGGGS

SEQ ID NO: 5 - protein, 3 aa, Artificial Sequence
  Description of Artificial Sequence: Synthetic peptide
AST

SEQ ID NO: 6 - protein, 6 aa, Artificial Sequence
  Description of Artificial Sequence: Synthetic peptide
TVAAPS

SEQ ID NO: 7 - protein, 3 aa, Artificial Sequence
  Description of Artificial Sequence: Synthetic peptide
TVA

SEQ ID NO: 8 - protein, 7 aa, Artificial Sequence
  Description of Artificial Sequence: Synthetic peptide
ASTSGPS

SEQ ID NO: 9 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFQEWGQGTLVTVSS

SEQ ID NO: 10 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSS

SEQ ID NO: 11 - protein, 116 aa, Artificial Sequence
  Description of Artificial Sequence: Synthetic polypeptide
EVQLLESGGGLVQPGGSLRLSCAASGFTFEWYEMQWVRQAPGKGLEWVSAISGDGYRTYYADSVKGRFTISRDNSKNTLYLQMNSLRAEDTAVYYCAKELGYFDYWGQGTLVTVSS

SEQ ID NO: 12 - protein, 116 aa, Artificial Sequence
  Description of Artificial Sequence: Synthetic polypeptide
EVQLLESGGGLVQPGGSLRLSCAASGFTFEEEEMIWVRQAPGKGLEWVSAISGSGGSTYYADSVKGRFTISRDNSKNTLYLQMNSLRAEDTAVYYCAKEPFRFDYWGQGTLVTVSS

SEQ ID NO: 13 - protein, 116 aa, Artificial Sequence
  Description of Artificial Sequence: Synthetic polypeptide
EVQLLESGGGLVQPGGSLRLSCAASGFTFTEYEMIWVRQAPGKGLEWVSSISGNGANTYYADSVKGRFTISRDNSKNTLYLQMNSLRAEDTAVYYCAKEPLRFDYWGQGTLVTVSS

SEQ ID NO: 14 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYAMRYARFDYWGQGTLVTVSS

SEQ ID NO: 15 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFIFDYWGQGTLVTVSS

SEQ ID NO: 16 - protein, 119 aa, Artificial Sequence
  Description of Artificial Sequence: Synthetic polypeptide
EVQLLESGGGLVQPGGSLRLSCAASGFTFSTYHMQWVRQAPGKGLEWVSMIDADGLGTYYADSVKGRFTISRDNSKNTLYLQMNSLRAEDTAVYYCAKPGPQFGQFDYWGQGTLVTVSS

SEQ ID NO: 17 - protein, 121 aa, Artificial Sequence
  Description of Artificial Sequence: Synthetic polypeptide
EVQLLESGGGLVQPGGSLRLSCAASGFTFSGYDMQWVRQAPGKGLEWVSTISASGVFTYYADSVKGRFTTSRDNSKNTLYLQMNSLRAEDTAVYYCAKYPNRFALNNFDYWGQGTLVTVSS

SEQ ID NO: 18 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGSGTDFTLTISSLQPEDFATYYCVQNAGWPGTFGQGTKVEIKR

SEQ ID NO: 19 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTDFTLTISSLQPEDFATYYCHQYASPPLTFGQGTKVEIKR

SEQ ID NO: 20 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAKDPYSFDYWGQGTLVTVSS

SEQ ID NO: 21 - protein, 120 aa, Artificial Sequence
  Description of Artificial Sequence: Synthetic polypeptide
EVQLLESGGGLVQPGGSLRLSCAASGFTFPTAEMVWVRQAPGKGLEWVSSISASGGSTYYADSVKGRFTISRDNSKNTLYLQMNSLRAEDTAVYYCAKEPVSYVATFDYWGQGTLVTVSS

SEQ ID NO: 22 - protein, 108 aa, Artificial Sequence
  Description of Artificial Sequence: Synthetic polypeptide
DIQMTQSPSSLSASVGDRVTITCRASHFIGTLLSWYQQKPGKAPKLLITYGSLLQSGVPSRFSGSGSGTDFTLTISSLQPEDFATYYCGQGVLWPATFGQGTKVEIKR

SEQ ID NO: 23 - protein, 119 aa, Artificial Sequence
  Description of Artificial Sequence: Synthetic polypeptide
EVQLLESGGGLVQPGGSLRLSCAASGFTFPKNEMTWVRQAPGKGLEWVSAIESDGQATYYADSVKGRFTISRDNSKNTLYLQMNSLRAEDTAVYYCAKNRIPDLVFDYWGQGTLVTVSS

SEQ ID NO: 24 - protein, 119 aa, Artificial Sequence
  Description of Artificial Sequence: Synthetic polypeptide
EVQLLESGGGLVQPGGSLRLSCAASGFTFDAGAMTWVRQAPGKGLEWVSSIDKEGLSTYYADSVKGRFTISRDNSKNTLYLQMNSLRAEDTAVYYCAKGRIPGLVFDYWGQGTLVTVSS

SEQ ID NO: 25 - protein, 119 aa, Artificial Sequence
  Description of Artificial Sequence: Synthetic polypeptide
EVQLLESGGGLVQPGGSLRLSCAASGFTFGDAAMTWVRQAPGKGLEWVSAIQPMGDGTYYADSVKGRFTVSRDNSKNTLYLQMNSLRAEDTAVYYCAKGRIPTLQFDYWGQGTLVTVSS

SEQ ID NO: 26 - protein, 119 aa, Artificial Sequence
  Description of Artificial Sequence: Synthetic polypeptide
EVQLLESGGGLVQPGGSLRLSCAASGFTFEDSPMTWVRQAPGKGLEWVSAITSNGYETYYADSVKGRFTISRDNSKNTLYLQMNSLRAEDTAVYYCAKGRIPTLHFDYWGQGTLVTVSS

SEQ ID NO: 27 - protein, 119 aa, Artificial Sequence
  Description of Artificial Sequence: Synthetic polypeptide
EVQLLESGGGLVQPGGSLRLSCAASGFTFDEHDMSWVRQAPGKGLEWVSRIGPDGFHTYYADSVKGRFTISRDNSKNTLYLQMNSLRAEDTAVYYCAKGRIPTLHFDYWGQGTLVTVSS

SEQ ID NO: 28 - protein, 119 aa, Artificial Sequence
  Description of Artificial Sequence: Synthetic polypeptide
EVQLLESGGGLVQPGGSLRLSCAASGFTFGEYHMSWVRQAPGKGLEWVSRITPLGTLTYYADSVKGRFTISRDNSKNTLYLQMNSLRAEDTAVYYCAKGRIPSLTFDYWGQGTLVTVSS

SEQ ID NO: 29 - protein, 119 aa, Artificial Sequence
  Description of Artificial Sequence: Synthetic polypeptide
EVQLLESGGGLVQPGGSLRLSCAASGFTFGTNAMSWVRQAPGKGLEWVSRISPGGDYTYYADSVKGRFTISRDNSKNTLYLQMNSLRAEDTAVYYCAKGRVPDLLFDYWGQGTLVTVSS

SEQ ID NO: 30 - protein, 119 aa, Artificial Sequence
  Description of Artificial Sequence: Synthetic polypeptide
EVQLLESGGGLVQPGGSLRLSCAASGFTFPSEEMSWVRQAPGKGLEWVSRISADGANTYYADSVKGRFTISRDNSKNTLYLQMNSLRAEDAAVYYCAKGRVPDLLFDYWGQGTLVTVSS

SEQ ID NO: 31 - protein, 119 aa, Artificial Sequence
  Description of Artificial Sequence: Synthetic polypeptide
EVQLLESGGGLVQPGGSLRLSCAASGFTFAEDDMTWVRQAPGKGLEWVSRIAVDGDRTYYADSVKGRFTISRDNSKNTLYLQMNSLRAEDTAVYYCAKGKVPSLHFDYWGQGTLVTVSS

SEQ ID NO: 32 - protein, 119 aa, Artificial Sequence
  Description of Artificial Sequence: Synthetic polypeptide
EVQLLESGGGLVQPGGSLRLSCAASGFTFRTMDMSWVRQAPGKGLEWVSRITGDGMNTYYADSVKGRFTISRDNSKNTLYLQMNSLRAGDTAVYYCAKGVTPDLTFDYWGQGTLVTVSS

SEQ ID NO: 33 - protein, 119 aa, Artificial Sequence
  Description of Artificial Sequence: Synthetic polypeptide
EVQLLESGGGLVQPGGSLRLSCAASGFTFERDDMTWVRQAPGKGLEWVSRINAGGVHTYYADSVKGRFTISRDNSKNTLYLQMNSLRAEDTAVYYCAKGVTPDLTFDYWGQGTLVTVSS

SEQ ID NO: 34 - protein, 119 aa, Artificial Sequence
  Description of Artificial Sequence: Synthetic polypeptide
EVQLLESGGGLVQPGGSLRLSCAASGFTFDDDSMTWVRQAPGKGLEWVSRISSDGASTYYADSVKGRFTISRDNSKNTLYLQMNSLRAEDTAVYYCAKGVTPDLTFDYWGQGTLVTVSS

SEQ ID NO: 35 - protein, 119 aa, Artificial Sequence
  Description of Artificial Sequence: Synthetic polypeptide
EVQLLESGGGLVQPGGSLRLSCAASGFTFTEEDMTWVRQAPGKGLEWVSRIDSVGEGTYYADSVKGRFTISRDNSKNTLYLQMNSLRAEDTAVYYCAKGVTPDLTFDYWGQGTLVTVSS

SEQ ID NO: 36 - protein, 119 aa, Artificial Sequence
  Description of Artificial Sequence: Synthetic polypeptide
EVQLLESGGGLVQPGGSLRLSCAASGFTFSDSAMSWVRQAPGKGLEWVSRIDNPGQHTYYADSVKGRFTISRDNSKNTLYLQMNSLRAEDTAVYYCAKGTVPTLEFDYWGQGTLVTVSS

SEQ ID NO: 37 - protein, 119 aa, Artificial Sequence
  Description of Artificial Sequence: Synthetic polypeptide
EVQLLESGGGLVQPGGSLRLSCAASGFTFGQHSMTWVRQAPGKGLEWVSRIDGGGYNTYYADSVKGRFTISRDNSKNTLYLQMNSLRAEDTAVYYCAKGEVPRLHFDYWGQGTLVTVSS

SEQ ID NO: 38 - protein, 119 aa, Artificial Sequence
  Description of Artificial Sequence: Synthetic polypeptide
EVQLLESGGGLVQPGGSLRLSCAASGFTFGQEPMTWVRQAPGKGLEWVSRIAYNGGDTYYADSVKGRFTISRDNSKNTLYLQMNSLRAEDTAVYYCAKGITPNLTFDYWGQGTLVTVSS

SEQ ID NO: 39 - protein, 119 aa, Artificial Sequence
  Description of Artificial Sequence: Synthetic polypeptide
EVQLLESGGGLVQPGGSLRLSCAASGFTFENYPMSWVRQAPGKGLEWVSRINATGSITYYADSVKGRFTISRDNSKNTLYLQMNSLRAEDTAVYYCAKGVIPHLMFDYWGQGTLVTVSS

SEQ ID NO: 40 - protein, 119 aa, Artificial Sequence
  Description of Artificial Sequence: Synthetic polypeptide
EVQLLESGGGLVQPGGSLRLSCAASGFTFRDYDMSWVRQAPGKGLEWVSRITGTGNSTYYADSVKGRFTISRDNSKNTLYLQMNSLRAEDTAVYYCAQGVVPYLAFDYWGQGTLVTVSS

SEQ ID NO: 41 - protein, 119 aa, Artificial Sequence
  Description of Artificial Sequence: Synthetic polypeptide
EVQLLESGGGLVQPGGSLRLSCAASGFTFEADAMTWVRQAPGKGLEWVSRINVDGDRTYYADSVKGRFTISRDNSKNTLYLQMNSLRAEDTAVYYCAKGTVPTLEFDYWGQGTLVTVSS

SEQ ID NO: 42 - protein, 119 aa, Artificial Sequence
  Description of Artificial Sequence: Synthetic polypeptide
EVQLLESGGGLVQPGGSLRLSCAASGFTFDRADMTWVRQAPGKGLEWVSRISGEGKCTYYADSVKGRFTISRDNSKNTLYLQMNSLRAEDTAVYYCAKGMVPNLVFDYWGQGTLVTVSS

SEQ ID NO: 43 - protein, 119 aa, Artificial Sequence
  Description of Artificial Sequence: Synthetic polypeptide
EVQLLESGGGLVQPGGSLRLSCAASGFTFHWEPMSWVRQAPGKGLEWVSRINSSGWDTYYADSVKGRFTISRDNSKNTLYLQMNSLRAEDTAVYYCAKGMVPNLVFDYWGQGTLVTVSS

SEQ ID NO: 44 - protein, 119 aa, Artificial Sequence
  Description of Artificial Sequence: Synthetic polypeptide
EVQLLESGGGLVQPGGSLRLSCAASGFTFADEPMTWVRQAPGKGLEWVSRIPPEGAPTYYADSVKGRFTISRDNSKNTLYLQMNSLRAEDTAVYYCAKGITPNLTFDYWGQGTLVTVSS

SEQ ID NO: 45 - protein, 119 aa, Artificial Sequence
  Description of Artificial Sequence: Synthetic polypeptide
EVQLLESGGGLVQPGGSLRLSCAASGFTFHNHDMSWVRQAPGKGLEWVSRISRGGLQTYYADSVKGRFTISRDNSKNTLYLQMNSLRAEDTAVYYCAKGIVPDLHFDYWGQGTLVTVSS

SEQ ID NO: 46 - protein, 119 aa, Artificial Sequence
  Description of Artificial Sequence: Synthetic polypeptide
EVQLLESGGGLVQPGGSLRLSCAASGFTFNEYPMSWVRQAPGKGLEWVSRINGDGANTYYADSVKGRFTISRDNSKNTLYLQMNSLRAEDTAVYYCAKGIIPAMQFDYWGQGTLVTVSS

SEQ ID NO: 47 - protein, 119 aa, Artificial Sequence
  Description of Artificial Sequence: Synthetic polypeptide
EVQLLESGGGLVQPGGSLRLSCAASGFTFGDVPMSWVRQAPGKGLEWVSRIDPYGSNTYYADSVKGRFTISRDNSKNTLYLQMNSLRAEDTAVYYCAKGIMPSLTFDYWGQGTLVTVSS

SEQ ID NO: 48 - protein, 119 aa, Artificial Sequence
  Description of Artificial Sequence: Synthetic polypeptide
EVQLLESGGGLVQPGGSLRLSCAASGFTFADYDMSWVRQAPGKGLEWVSRISALGATTYYADSVKGRFTISRDNSKNTLYLQMNSLRAEDTAVYYCAKGQLPALEFDYWGQGTLVTVSS

SEQ ID NO: 49 - protein, 119 aa, Artificial Sequence
  Description of Artificial Sequence: Synthetic polypeptide
EVQLLESGGGLVQPGGSLRLSCAASGFTFKRYYMTWVRQAPGKDLEWVSGIVPSGNRTYYADSVKGRFTISRDNSKNTLYLQMNSLRAEDTAVYYCAKGRIPDLHFDYWGQGTLVTVSS

SEQ ID NO: 50 - protein, 122 aa, Artificial Sequence
  Description of Artificial Sequence: Synthetic polypeptide
EVQLLESGGGLVQPGGSLRLSCAASGFTFADYDMTWVRQAPGKGLEWVSRISPTGGQTYYADSVKGRFTISRDNSKNTLYLQMNSLRAEDTAVYYCAKGVIPYLSFSPFDYWGQGTLVTVSS

SEQ ID NO: 51 - protein, 122 aa, Artificial Sequence
  Description of Artificial Sequence: Synthetic polypeptide
EVQLLESGGGLVQPGGSLRLSCAASGFTFSKYWMGWARQAPGKGLEWVSSIDSHGAGTYYADSVKGRFTISRDNSKNTLYLQMNSLRVEDTAVYYCAKGAPKFMTTYTFDYWGQGTLVTVSS

SEQ ID NO: 52 - protein, 117 aa, Artificial Sequence
  Description of Artificial Sequence: Synthetic polypeptide
EVQLLESGGGLVQPGGSLRLSCAASGFTFLSYPMHWVRQAPGKGLEWVSSIDSRGSVTYYADSVKGRFTISRDNSKNTLYLQMNSLRAEDTAVYYCAKGHSWTFDYWGQGTLVTVSS

SEQ ID NO: 53 - protein, 119 aa, Artificial Sequence
  Description of Artificial Sequence: Synthetic polypeptide
EVQLLESGGGLVQPGGSLRLSCAASGFTFANSNMTWVRQAPGKGLEWVSRINPDGGSTYYADSVKGRFTISRDNSKNTLYLQMNSLRAEDTAVYYCAEGRIPTLHFDYWGQGTLVTVSS

SEQ ID NO: 54 - protein, 119 aa, Artificial Sequence
  Description of Artificial Sequence: Synthetic polypeptide
EVQLLESGGGLVQPGGSLRLSCAASGFTFGPRRMGWVRQAPGKGLEWVSSIDDIGRRTYYADSVKGRFTISRDNSKNTLYLQMNSLRAEDTAVYYCAEGAQGVLLFDYWGQGTLVTVSS

SEQ ID NO: 55 - protein, 117 aa, Artificial Sequence
  Description of Artificial Sequence: Synthetic polypeptide
EVQLLESGGGLVQPGGSLRLSCAASGFTFEDYRMVWVRQAPGKGLEWVSSISTSGELTYYADSVKGRFTISRDNSKNTLYLQMNSLRAEDTAVYYCAETAGQFFDYWGQGTLVTVSS

SEQ ID NO: 56 - protein, 116 aa, Artificial Sequence
  Description of Artificial Sequence: Synthetic polypeptide
EVQLLESGGGLVQPGGSLRLSCAASGFTFPEYEMVWVRQAPGKGLEWVSAISREGRATYYADSVKGRFTISRDNSKNTLYLQMNNLRAEDTAVYYCAKEPVRFDYWGQGTLVTVSS

SEQ ID NO: 57 - protein, 116 aa, Artificial Sequence
  Description of Artificial Sequence: Synthetic polypeptide
EVQLLESGGGLVQPGGSLRLSCAASGFTFSTYEMLWVRQAPGKGLEWVSSISSSGNYTYYADSVKGRFTISRDNSKNTLYLQMNSLRAEDTAVYYCAKEPLMFDYWGQGTLVTVSS

SEQ ID NO: 58 - protein, 116 aa, Artificial Sequence
  Description of Artificial Sequence: Synthetic polypeptide
EVQLLESGGGLVQPGGSLRLSCAASGFTFDTEEMSWVRQAPGKGLEWVSAISPNGAFTFYADSVKGRFTISRDNSKNTLYLQMNSLRAEDTAVYYCAKEPILFDYWGQGTLVTVSS

SEQ ID NO: 59 - protein, 117 aa, Artificial Sequence
  Description of Artificial Sequence: Synthetic polypeptide
EVQLLESGGGLVQPGGSLRLSCAASGFTFGHYDMVWVRQAPGRGLEWVSTINGAGLNTYYADSVKGRFTISRDNSKNTLYLQMNSLRAEDTAVYYCAQSASRIFDYWGQGTLVTVSS

SEQ ID NO: 60 - protein, 117 aa, Artificial Sequence
  Description of Artificial Sequence: Synthetic polypeptide
EVQLLESGGGLVQPGGSLRLSCAASGFTFRSYEMAWVRQAPGKGLEWVSSISTLGTKTYYADSVKGRFTISRDNSKNTLYLQMNSLRAEDTAVYYCAQSSTHIFDYWGQGTLVTVSS

SEQ ID NO: 61 - protein, 117 aa, Artificial Sequence
  Description of Artificial Sequence: Synthetic polypeptide
EVQLLESGGGLVQPGGSLRLSCAASGFTFIRYEMAWVRQAPGKGLEWVSSISSSGWTTYYADSVKGRFTISRDNSKNTLYLQMNSLRAEDTAVYYCAKSDAHIFDYWGQGTLVTVSS

SEQ ID NO: 62 - protein, 117 aa, Artificial Sequence
  Description of Artificial Sequence: Synthetic polypeptide
EVQLLESGGGLVQPGGSLRLSCAASGFTFYAYEMAWVRQAPGKGLEWVSSISDDGTRTYYADSVKGRFTISRDNSKNTLYLQMNSLRAEDTAVYYCAKDLGQGFDYWGQGTLVTVSS

SEQ ID NO: 63 - protein, 119 aa, Artificial Sequence
  Description of Artificial Sequence: Synthetic polypeptide
EVQLLESGGGLVQPGGSLRLSCAASGFTFADHGMTWVRQAPGKGLEWVSGIGPSGEATYYADSVKGRFTISRDNSKNTLYLQMNSLRAEDTAVYYCAKDRIPNLVFDYWGQGTLVTVSS

SEQ ID NO: 64 - protein, 116 aa, Artificial Sequence
  Description of Artificial Sequence: Synthetic polypeptide
EVQLLESGGGLVQPGGSLRLSCAASGFTFESQDMSWVRQAPGKGLEWVSGISPNGWDTYYADSVKGRFTISRDNSKNTLYLQMNSLRAEDTAVYYCAKDRSDFDYWGQGTLVTVSS

SEQ ID NO: 65 - protein, 117 aa, Artificial Sequence
  Description of Artificial Sequence: Synthetic polypeptide
EVQLLESGGGLVQPGGSLRLSCAASGFTFGDYDMWWVRQAPGKGLEWVSRIRHPGGVTYYADSVKGRFTISRDNSKNTLYLQMNSLRAEDTAVYYCAKAVPKGFDYWGQGTLVTVSS

SEQ ID NO: 66 - protein, 119 aa, Artificial Sequence
  Description of Artificial Sequence: Synthetic polypeptide
EVQLLESGGGLVQPGGSLRLSCAASGFTFRVYWMTWVRQAPGKGLEWVSSIDPQGGMTYYADSVKGRFTISRDNSKNTLYLQMNSLRAEDTAVYYCAKARIPNLEFDYWGQGTLVTVSS

SEQ ID NO: 67 - protein, 119 aa, Artificial Sequence
  Description of Artificial Sequence: Synthetic polypeptide
EVQLLESGGGLVQPGESLRLSCAASGFTFSAYDMTWVRQAPGKGLEWVSRINPTGSYTYYADSVKGRFTISRDNSKNTLYLQMNSLRAEDTAVYYCAKAKIPNLVFDYWGQGTLVTVSS

SEQ ID NO: 68 - protein, 121 aa, Artificial Sequence
  Description of Artificial Sequence: Synthetic polypeptide
EVQLLESGGGLVQPGGSLRLSCAASGFTFADSEMMWVRQAPGKGLEWVSGIAHNGGHTYYADSVKGRFTISRDNSKNTLYLQMNSLRAEDTAVYYCAKAGHPQQTEAFDYWGQGTLVTVSS

SEQ ID NO: 69 - protein, 116 aa, Artificial Sequence
  Description of Artificial Sequence: Synthetic polypeptide
EMQLLESGGGLVQPGGSLRLSCAASGFTFATYDMYWVRQAPGKGLEWVSKISPNGWSTYYADSVKGRFTISRDNSKNTLYLQMNSLRAEDTAVYYCAKYQTHFDYWGQGTLVTVSS

SEQ ID NO: 70 - protein, 116 aa, Artificial Sequence
  Description of Artificial Sequence: Synthetic polypeptide
EVQLLESGGGLVQPGGSLRLSCAASGFTFSVYDMRWVRQAPGKGLEWVSTISSSGTYTYYADSVKGRFTISRDNSKNTLYLQMNSLRAEDTAVYYCAKYPKNFDYWGQGTLVTVSS

SEQ ID NO: 71 - protein, 117 aa, Artificial Sequence
  Description of Artificial Sequence: Synthetic polypeptide
EVQLLESGGGLVQPGGSLRLSCAASGFTFSHEDMTWVRQAPGKGLEWVSSISPNGWDTYYADSVKGRFTISRDNSKNTLYLQMNSLRAEDTAVYYCAKRTRSKFDYWGQGTLVTVSS

SEQ ID NO: 72 - protein, 120 aa, Artificial Sequence
  Description of Artificial Sequence: Synthetic polypeptide
EVQLLESGGGLVQPGGSLRLSCAASGFTFEKYIMGWARQAPGKGLEWVSTIDYWGQHTYYADSVKGRFTISRDNSKNTLYLQMNSLRAEDTAVYYCAKRSHLIPLQFDYWGQGTLVTVSS

SEQ ID NO: 73 - protein, 123 aa, Artificial Sequence
  Description of Artificial Sequence: Synthetic polypeptide
EVQLLESGGGLVQPGGSLRLSCAASGFTFSDYAMGWVRQAPGKGLEWVSTISYVGYYTYYADSVKGRFTISRDNSKNTLYLQMNSLRAEDTAVYYCAKKALRGEAFTERFDYWGQGTLVTVSS

SEQ ID NO: 74 - protein, 123 aa, Artificial Sequence
  Description of Artificial Sequence: Synthetic polypeptide
EVQLLESGGGLVQPGGSLRLSCAASGFTFGPYMMHWVRQAPGKGLEWVSTIEVNGNRTYYADSVKGRFTISRDNSKNTLYLQMNSLRAEDTAVYYCAKWVGSKTSSDKSFDYWGQGTLVTVSS

SEQ ID NO: 75 - protein, 120 aa, Artificial Sequence
  Description of Artificial Sequence: Synthetic polypeptide
EVQLLESGGGLVQPGGSLRLSCAASGFTFGTTEMAWVRQAPGKGLEWVSSIGSAGAWTYYADSVKGRFTISRDNSKNTLYLQMNSLRAEDTAVYYCAKIGGHPQGQFDYWGQGTLVTVSS

SEQ ID NO: 76 - protein, 119 aa, Artificial Sequence
  Description of Artificial Sequence: Synthetic polypeptide
EVQLLESGGGLVQPGGSLRLSCAASGFTFPREWMAWVRQAPGKGLEWVSSIQPMGQTTYYADSVKGRFTISRDNSKNTLYLQMNSLRAEDTAVYYCAKYSRNKGFFDYWGQGTLVTVSS

SEQ ID NO: 77 - protein, 119 aa, Artificial Sequence
  Description of Artificial Sequence: Synthetic polypeptide
EVQLLESGGGLVQPGGSLRLSCAASGFTFTSEYMGWVRQAPGKGLEWVSSIQRYGSTTYYADSVKGRFTISRDNSKNTLYLQMNSLRAEDTAVYYCAKHESNWETFDYWGQGTLVTVSS

SEQ ID NO: 78 - protein, 123 aa, Artificial Sequence
  Description of Artificial Sequence: Synthetic polypeptide
EVQLLESGGGLVQPGGSLRLSCAASGFTFSVYSMQWVRQAPGKGLEWVSAITPNGTRTYYADSVKGRFTISRDNSKNTLYLQMNSLRAEDTAVYYCAKTLGRGSYPGVDFDYWGQGTLVTVSS

SEQ ID NO: 79 - protein, 119 aa, Artificial Sequence
  Description of Artificial Sequence: Synthetic polypeptide
EVQLLESGGGLVQPGGSLRLSCAASGFTFPSYAMTWVRQAPGKGLEWVSRITADGTVTYYADSVKGRFTISRDNSKNTLYLQMNSLRAEDTAVYYCAKGSIPMLTFDYWGQGTLVTVSS

SEQ ID NO: 80 - protein, 120 aa, Artificial Sequence
  Description of Artificial Sequence: Synthetic polypeptide
EVQLLESGGGLVQPGGSLRLSCAASGFTFSTYDMIWVRQAPGKGLEWVSAISPNGTGIYYADSVKGRFTISRDNSKNTLYLQMNSLRAEDTAVYYCAKNQSVHHAVFDYWGQGTLVTVSS

SEQ ID NO: 81 - protein, 119 aa, Artificial Sequence
  Description of Artificial Sequence: Synthetic polypeptide
EVQLLESGGGLVQPGGSLRLSCAASGFTFENYEMTWVRQAPGKGLEWVSRIAPHGRLTYYADSVKGRFTISRDNSKNTLYLQMNSLRAEDTAVYYCAKGQIPMLDFDYWGQGTLVTVSS

SEQ ID NO: 82 - protein, 121 aa, Artificial Sequence
  Description of Artificial Sequence: Synthetic polypeptide
EVQLLESGGGLVQPGGSLRLSCAASGFTFSHYMMMWVRQAPGKGLEWVSTISHFGDITYYADSVKGRFTISRDNSKNTLYLQMNSLRAEDTAVYYCAKNDMVMKNGGFDYWGQGTLVTVSS

SEQ ID NO: 83 - protein, 119 aa, Artificial Sequence
  Description of Artificial Sequence: Synthetic polypeptide
EVQLLESGGGLVQPGGSLRLSCAASGFTFERYDMSWVRQAPGKGLEWVSRIDSRGWSTYYADSVKGRFTISRDNSKNTLYLQMNSLRAEDTAVYYCAKGLVPHLRFDYWGQGTLVTVSS

SEQ ID NO: 84 - protein, 117 aa, Artificial Sequence
  Description of Artificial Sequence: Synthetic polypeptide
EVQLLESGGGLVQPGGSLRLSCAASGFTFANAQMTWVRQAPGKGLEWVSRIDAMGDATYYADSVKGRFTISRDNSKNTLYLQMNSLRAEDTAVYYCAKGKVPSIDYWGQGTLVTVSS

SEQ ID NO: 85 - protein, 117 aa, Artificial Sequence
  Description of Artificial Sequence: Synthetic polypeptide
EVQLLESGGGLVQPGGSLRLSCAASGFTFANAQMTWVRQAPGKGLEWVSRIDAMGDATYYADSVKGRFTISRDNSKNTLYLQMNSLRAEDTAVYYCAKGVIPAFDYWGQGTLVTVSS

SEQ ID NO: 86 - protein, 118 aa, Artificial Sequence
  Description of Artificial Sequence: Synthetic polypeptide
EVQLLESGGGLVQPGGSLRLSCAASGFTFQNDRMHWVRQAPGKGLEWVSSISATGGDTYYADSVKGRFTISRDNSKNTLYLQMNSLRAEDTAVYYCAKQTGTNRFDYWGQGTLVTVSS

SEQ ID NO: 87 - protein, 119 aa, Artificial Sequence
  Description of Artificial Sequence: Synthetic polypeptide
EVQLLESGGGLVQPGGSLRLSCAASGFTFNQPYMSWVRQAPGKGLEWVSSIDASGGTTYYADSVKGRFTISRDNSKNTLYLQMNSLRAEDAAVYYCAKDRIPNLVFDYWGQGTLVTVSS

SEQ ID NO: 88 - protein, 119 aa, Artificial Sequence
  Description of Artificial Sequence: Synthetic polypeptide
EVQLLESGGGLVQPGGSLRLSCAASGFTFDNENMTWVRQAPGKGLEWVSRIDGGGYNTYYADSVKGRFTISRDNSKNTLYLQMNSLRAEDTAVYYCAKGQVPELLFDYWGQGTLVTVSS

SEQ ID NO: 89 - protein, 119 aa, Artificial Sequence
  Description of Artificial Sequence: Synthetic polypeptide
EVQLLESGGGLVQPGGSLRLSCAASGFTFVSSNMTWVRQAPGKGLEWVSAISGSGGSTYYADSVKGRFTISRDNSKNTLYLQMNSLRAEDTAVYYCAKGRIPTLVFDYWGQGTLVTVSS

SEQ ID NO: 90 - protein, 119 aa, Artificial Sequence
  Description of Artificial Sequence: Synthetic polypeptide
EVQLLESGGGLVQPGGSLRLSCAASGFTFVSSNMTWVRQAPGKGLEWVSAISGSGGSTYYADSVKGRFTISRDNSKNTLYLQMNSLRAEDTAVYYCAKDRIPNLVFDYWGQGTLVTVSS

SEQ ID NO: 91 - protein, 119 aa, Artificial Sequence
  Description of Artificial Sequence: Synthetic polypeptide
EVQLLESGGGLVQPGGSLRLSCAASGFTFSDDSMSWVRQAPGKGLEWVSRINDAGSSTYYADSVKGRFTISRDNSKNTLYLQMNSLRAEDTAVYYCAKGTIPLLEFDYWGQGTLVTVSS

SEQ ID NO: 92 - protein, 119 aa, Artificial Sequence
  Description of Artificial Sequence: Synthetic polypeptide
EMQLLESGGGLVQPGGSLRLSCAASGFTFVSDTMSWVRQAPGKGLEWVSRIDGTGGDTYYADSVKGRFTISRDNSKNTLYLQMNSLRAGDTAVYYCAKGLIPDLQFDYWGQGTLVTVSS

SEQ ID NO: 93 - protein, 119 aa, Artificial Sequence
  Description of Artificial Sequence: Synthetic polypeptide
EVQLLESGGGLVQPGGSLRLSCAASGFTFDEEEMTWVRQAPGKGLEWVSRIIGGGHETYYADSVKGRFTISRDNSKNTLYLQMNSLRAEDTAVYYCAKGTIPLLEFDYWGQGTLVTVSS

SEQ ID NO: 94 - protein, 119 aa, Artificial Sequence
  Description of Artificial Sequence: Synthetic polypeptide
EVQLLESGGGLVQPGGSLRLSCAASGFTFDNENMTWVRQAPGKDLEWVSRITERGDVTYYADSVKGRFTISRDNSKNTLYLQMNSLRAEDTAVYYCAKGTVPTLEFDYWGQGTLVTVSS

SEQ ID NO: 95 - protein, 119 aa, Artificial Sequence
  Description of Artificial Sequence: Synthetic polypeptide
EVQLLESGGGLVQPGGSLRLSCAASGFTFDEEEMTWVRQAPGKGLEWVSRIIGGGHETYYADSVKGRFTISRDNSKNTLYLQMNSLRAEDTAVYYCAKGTVPTLEFDYWGQGTLVTVSS

SEQ ID NO: 96 - protein, 119 aa, Artificial Sequence
  Description of Artificial Sequence: Synthetic polypeptide
EVQLLESGGGLVQPGGSLRLSCAASGFTFHETEMTWVRQAPGKGLEWVSAINRLGQDTYYADSVKGRFTISRDNSKNTLYLQMNSLRAEDTAVYYCAKGRIPGLVFDYWGQGTLVTVSS

SEQ ID NO: 97 - protein, 119 aa, Artificial Sequence
  Description of Artificial Sequence: Synthetic polypeptide
EVQLLESGGGLVQPGGSLRLSCAASGFTFSDDSMSWVRQAPGKGLEWVSRINDAGSSTYYADSVKGRFTISRDNSKNTLYLQMNSLRAEDTAVYYCAKGTVPTLEFDYWGQGTLVTVSS

SEQ ID NO: 98 - protein, 119 aa, Artificial Sequence
  Description of Artificial Sequence: Synthetic polypeptide
EVQLLESGGGLVQPGGSLRLSCAASGFTFDNENMTWVRQAPGKDLEWVSRITERGDVTYYADSVKGRFTISRDNSKNTLYLQMNSLRAEDTAVYYCAKGRIPTLVFDYWGQGTLVTVSS

SEQ ID NO: 99 - protein, 119 aa, Artificial Sequence
  Description of Artificial Sequence: Synthetic polypeptide
EVQLLESGGGLVQPGGSLRLSCAASGFTFSDDSMSWVRQAPGKGLEWVSRINDAGSSTYYADSVKGRFTISRDNSKNTLYLQMNSLRAEDTAVYYCAKGITPNLTFDYWGQGTLVTVSS

SEQ ID NO: 100 - protein, 119 aa, Artificial Sequence
  Description of Artificial Sequence: Synthetic polypeptide
EVQLLESGGGLVQPGGSLRLSCAASGFTFADEPMTWVRQAPGKGLEWVSRIPPEGAPTYYADSVKGRFTISRDNSKNTLYLQMNSLRAEDTAVYYCAKGLIPDLQFDYWGQGTLVTVSS

SEQ ID NO: 101 - protein, 119 aa, Artificial Sequence
  Description of Artificial Sequence: Synthetic polypeptide
EVQLLESGGGLVQPGGSLRLSCAASGFTFQDSDMTWVRQAPGKGLEWVSAIAAPGGSTYYADSVKGRFTISRDNSKNTLYLQMNSLRAEDTAVYYCAKDRIPNLRFDYWGQGTLVTVSS

SEQ ID NO: 102 - protein, 119 aa, Artificial Sequence
  Description of Artificial Sequence: Synthetic polypeptide
EVQLLESGGGLVQPGGSLRLSCAASGFTFVSDTMSWVRQAPGKGLEWVSRIDGTGGDTYYADSVKGRFTISRDNSKNTLYLQMNSLRAEDTAVYYCAKGQVPELLFDYWGQGTLVTVSS

SEQ ID NO: 103 - protein, 119 aa, Artificial Sequence
  Description of Artificial Sequence: Synthetic polypeptide
EVQLLESGGGLVQPGGSLRLSCAASGFTFQDSDMTWVRQAPGKGLEWVSAIAAPGGSTYYADSVKGRFTISRDNSKNTLYLQMNSLRAEDTAVYYCAKDRIPNLVFDYWGQGTLVTVSS

SEQ ID NO: 104 - protein, 119 aa, Artificial Sequence
  Description of Artificial Sequence: Synthetic polypeptide
EVQLLESGGGLVQPGGSLRLSCAAAGFTFDLAEMTWVRQAPGKGLEWVSRIDEDGASTYYADSVKGRFTISRDNSKNTLYLQMNSLRAEDAAVYYCAEGVIPSLTFDYWGQGTLVTVSS

SEQ ID NO: 105 - protein, 119 aa, Artificial Sequence
  Description of Artificial Sequence: Synthetic polypeptide
EVQLLESGGGLVQPGGSLRLSCAASGFTFTDKHMSWVRQAPGKGLEWVSRISPDGTYTYYADSVKGRFTISRDNSKNTLYLQMNSLRAEDAAVYYCAEGVIPSLTFDYWGQGTLVTVSS

SEQ ID NO: 106 - protein, 119 aa, Artificial Sequence
  Description of Artificial Sequence: Synthetic polypeptide
EVQLLESGGGLVQPGGSLRLSCAASGFTFAEDDMTWVRQAPGKGLEWVSRIAVDGDRTYYADSVKGRFTISRDNSKNTLYLQMNSLRTEDTAVYYCAKGKTPHLVFDYWGQGTLVTVSS

SEQ ID NO: 107 - protein, 119 aa, Artificial Sequence
  Description of Artificial Sequence: Synthetic polypeptide
EVQLLESGGGLVQPGGSLRLSCAAAGFTFDLAEMTWVRQAPGKGLEWVSRIDEDGASTYYADSVKGRFTISRDNSKNTLYLQMNSLRAEDTAVYYCAKGQVPALVFDYWGQGTLVTVSS

SEQ ID NO: 108 - protein, 119 aa, Artificial Sequence
  Description of Artificial Sequence: Synthetic polypeptide
EVQLLESGGGLVQPGGSLRLSCAASGFTFEDSMMSWVRQAPGKGLEWVSRIDPGGAQTYYADSVKGRFTISRDNSKNTLYLQMNSLRAEDTAVYYCAKGVTPDLTFDYWGQGTLVTVSS

SEQ ID NO: 109 - protein, 119 aa, Artificial Sequence
  Description of Artificial Sequence: Synthetic polypeptide
EVQLLESGGGLVQPGGSLRLSCAASGFTFEHADMSWVRQASGKGLEWVSRIDNSGQSTYYADSVKGRFTISRDNSKNTLYLQMNSLRAEDTAVYYCAKGVTPDLTFDYWGQGTLVTVSS

SEQ ID NO: 110 - protein, 119 aa, Artificial Sequence
  Description of Artificial Sequence: Synthetic polypeptide
EVQLLESGGGLVQPGGSLRLSCAASGFTFSEAEMNWVRQAPGKGLEWVSRITTDGDSTYYADSVKGRFTISRDNSKNTLYLQMNSLRAEDTAVYYCAKGRIPTLHFDYWGQGTLVTVSS

SEQ ID NO: 111 - protein, 119 aa, Artificial Sequence
  Description of Artificial Sequence: Synthetic polypeptide
EVQLLESGGGLVQPGGSLRLSCAASGFTFDDSDMTWVRQAPGKSLEWVSYIRGDDDETYYADSVKGRFTISRDNSKNTLYLQMNSLRAEDTAVYYCAKNRIPDLVFDYWGQGTLVTVSS

SEQ ID NO: 112 - protein, 121 aa, Artificial Sequence
  Description of Artificial Sequence: Synthetic polypeptide
EVQLLESGGGLVQPGGSLRLSCAASGFTFNVADMQWVRQAPGKGLEWVSSISPNGWDTYYADSVKGRFTISRDNSKNTLYLQMNSLRAEDTAVYYCAKHASTEGPTAFDYWGQGTLVTVSS

SEQ ID NO: 113 - protein, 116 aa, Artificial Sequence
  Description of Artificial Sequence: Synthetic polypeptide
EVQLLESGGGLVQPGGSLRLSCAASGFTFGPYDMGWVRQAPGKGLEWVSWISAHGSFTYYADSVKGRFTISRDNSKNTLYLQMNSLRAEDTAVYYCAKWPYKFDYWGQGTLVTVSS

SEQ ID NO: 114 - protein, 119 aa, Artificial Sequence
  Description of Artificial Sequence: Synthetic polypeptide
EVQLLESGGGLVQPGGSLRLSCAASGFTFGSGSMSWVRQAPGKGLEWVSRIGSNGADTYYADSVKGRFTISRDNSKNTLYLQMNSLRAEDTAVYYCAKGMVPNLVFDYWGQGTLVTVSS

SEQ ID NO: 115 - protein, 119 aa, Artificial Sequence
  Description of Artificial Sequence: Synthetic polypeptide
EVQLLESGGGLVQPGGSLRLSCAASGFTFNRFDMTWVRQAPGKGLEWVSAISGSGGSTYYADSVKGRFTISRDNSKNTLYLQMNSLRAEDTAVYYCAKDRIPNLVFDYWGQGTLVTVSS

SEQ ID NO: 116 - protein, 119 aa, Artificial Sequence
  Description of Artificial Sequence: Synthetic polypeptide
EVQLLESGGGLVQPGGSLRLSCAASGFTFGESDMKWVRQAPGKGLEWVSSISPNGWDTYYADSVKGRFTISRDNSKNTLYLQMNSLRAEDTAVYYCAKSPSSRLKFDYWGQGTLVTVSS

SEQ ID NO: 117 - protein, 119 aa, Artificial Sequence
  Description of Artificial Sequence: Synthetic polypeptide
EVQLLESGGGLVQPGGSLRLSCAASGFTFDSSEMSWVRQAPGKGLEWVSSIENQGGATYYADSVKGRFTISRDNSKNTLYLQMNSLRAEDTAVYYCAKDRIPNLVFDYWGQGTLVTVSS

SEQ ID NO: 118 - protein, 116 aa, Artificial Sequence
  Description of Artificial Sequence: Synthetic polypeptide
EVQLLESGGGLVQPGGSLRLSCAASGFTLDAYPMYWVRQAPGKGLEWVSWIASGGGATYYADSVKGRFTISRDNSKNTLYLQMNSLRAEDTAVYYCAKRTKNFDYWGQGTLVTVSS

SEQ ID NO: 119 - protein, 120 aa, Artificial Sequence
  Description of Artificial Sequence: Synthetic polypeptide
EVQLLESGGGLVQPGGSLRLSCAASGFTFMSYSMAWVRQAPGKGLEWVSGITSNGNRTYYADSVKGRFTISRDNSKNTLYLQMNSLRAEDTAVYYCAKSTGANSRNFDYWGQGTLVTVSS

SEQ ID NO: 120 - protein, 121 aa, Artificial Sequence
  Description of Artificial Sequence: Synthetic polypeptide
EVQLLESGGGLVQPGGSLRLSCAASGFTFEGYLMSWVRQAPGKGLEWVSSIAANGMQTYYADSVKGRFTISRDNSKNTLYLQMNSLRAEDTAVYYCAKKPRGIWDGDFDYWGQGTLVTVSS

SEQ ID NO: 121 - protein, 119 aa, Artificial Sequence
  Description of Artificial Sequence: Synthetic polypeptide
EVQLLESGGGLVQPGGSLRLSCAASGFTFHESTMTWVRQAPGKGLEWVSTIRHPGEFTYYADSVKGRFTISRDNSKNTLYLQMNSLRAGDTAVYYCAKGLIPDLQFDYWGQGTLVTVSS

SEQ ID NO: 122 - protein, 121 aa, Artificial Sequence
  Description of Artificial Sequence: Synthetic polypeptide
EVQLLESGGGLVQPGGSLRLSCAASGFTFAMYSMSWVRQAPGKGLEWVSSIAPPGGRTYYADSVKGRFTISRDNSKNTLYLQMNSLRAEDTAVYYCAKQSLTGYSRSFDYWGQGTLVTVSS

SEQ ID NO: 123 - protein, 120 aa, Artificial Sequence
  Description of Artificial Sequence: Synthetic polypeptide
EVQLLESGGGLVQPGGSLRLSCAASGFTFSQNPMSWVRHAPGKGLEWVSTIPANGRPTSYADSVKGRFTISRDNSKNTLYLQMNSLRAEDTAVYYCAKYSQQPGRRFDYWGQGTLVTVSS

SEQ ID NO: 124 - protein, 119 aa, Artificial Sequence
  Description of Artificial Sequence: Synthetic polypeptide
EVQLLESGGGLVQPGGSLRLSCAASGFTFANYHMTWVRQAPGKGLEWVSSIPDSGKQTYYADSVKGRFTISRDNSKNTLYLQMNSLRAEDTAVYYCAKGRIPSLLFDYWGQGTLVTVSS

SEQ ID NO: 125 - protein, 120 aa, Artificial Sequence
  Description of Artificial Sequence: Synthetic polypeptide
EVQLLESGGGLVQPGGSLRLSCAASGFTFAQYHMRWVRQAPGKGLEWVSTINDIGSNTYYADSVKGRFTISRDNSKNTLYLQMNSLRAEDTAVYYCAKVGGRGSFSFDYWGQGTLVTVSS

SEQ ID NO: 126 - protein, 120 aa, Artificial Sequence
  Description of Artificial Sequence: Synthetic polypeptide
EVQLLESGGGLVQPGGSLRLSCAASGFTFSSYDMKWVRQAPGKGLEWVSTISASGVFTYYADSVKGRFTISRDNSKNTLYLQMNSLRAEDTAVYYCAKREHAGQPPFDYWGQGTLVTVSS

SEQ ID NO: 127 - protein, 120 aa, Artificial Sequence
  Description of Artificial Sequence: Synthetic polypeptide
EVQLLESGGGLVQPGGSLRLSCAASGFTFNGYAMSWVRQAPGKGLEWVSTINANGKYTYYADSVKGRFTISRDNSKNTLYLQMNSLRAEDTAVYYCAKKLTLASNYFDYWGQGTLVTVSS

SEQ ID NO: 128 - protein, 121 aa, Artificial Sequence
  Description of Artificial Sequence: Synthetic polypeptide
EVQLLESGGGLVQPGGSLRLSCAASGFTFMDYDMKWVRQAPGKGLEWVSSITALGKKTYYADSVKGRFTISRDNSKNTLYLQMNSLRAEDTAVYYCAKDSVKYPLNLFDYWGQGTLVTVSS

SEQ ID NO: 129 - protein, 120 aa, Artificial Sequence
  Description of Artificial Sequence: Synthetic polypeptide
EVQLLESGGGLVQPGGSLRLSCAASGFTFPHYTMAWVRQAPGKGLEWVSSIQSPGWRTYYADSVKGRFTISRDNSKNTLYLQMNSLRAEDTAVYYCAKYGDGLPLTFDYWGQGTLVTVSS

SEQ ID NO: 130 - protein, 119 aa, Artificial Sequence
  Description of Artificial Sequence: Synthetic polypeptide
EVQLLESGGGLVQPGGSLRLSCAASGFTFSGTPMSWVRQAPGKGLEWVSRIGDEGQETYYADSVKGRFTISRDNSKNTLYLQMNSLRAEDTAVYYCAKGVTPDLTFDYWGQGTLVTVSS

SEQ ID NO: 131 - protein, 119 aa, Artificial Sequence
  Description of Artificial Sequence: Synthetic polypeptide
EVQLLESGGGLVQPGGSLRLSCAASGFTFSSSSMSWVRQAPGKGLEWVSAIGSDGPSTYYADSVKGRFTISRDNSKNTLYLQMNSLRAEDTAVYYCAKGRIPTLHFDYWGQGTLVTVSS

SEQ ID NO: 132 - protein, 119 aa, Artificial Sequence
  Description of Artificial Sequence: Synthetic polypeptide
EVQLLESGGGLVQPGGSLRLSCAASGFTFNPGEMTWVRQAPGKGLEWVSSIDGSGSSTYYADSVKGRFTISRDNSKNTLYLQMNSLRADDTAVYYCAKGRIPTLHFDYWGQGTLVTVSS

SEQ ID NO: 133 - protein, 119 aa, Artificial Sequence
  Description of Artificial Sequence: Synthetic polypeptide
EVQLLESGGGLVQPGGSLRLSCAASGFTFPESMMGWVRQAPGKGLEWVSSIGYPGATTYYADSVKGRFTISRDNSKNTLYLQMNSLRAEDTAVYYCAKGGSRDDNFDYWGQGTLVTVSS

SEQ ID NO: 134 - protein, 124 aa, Artificial Sequence
  Description of Artificial Sequence: Synthetic polypeptide
EVQLLESGGGLVQPGGSLRLSCAASGFTFGQHSMHWVRQAPGKGLEWVSSISVPGPKTYYADSVKGRFTISRDNSKNTLYLQMNSLRAEDTAVYYCAKSLRDLRPGDSKSFDYWGQGTLVTVSS

SEQ ID NO: 135 - protein, 116 aa, Artificial Sequence
  Description of Artificial Sequence: Synthetic polypeptide
EVQLLESGGGLVQPGGSLRLSCAASGFTFGSAAMDWVRQAPGKGLEWVSSINDMGSNTYYADSVKGRFTISRDNSKNTLYLQMNSLRAEDTAVYYCAKQGGRFDYWGQGTLVTVSS

SEQ ID NO: 136 - protein, 118 aa, Artificial Sequence
  Description of Artificial Sequence: Synthetic polypeptide
EVQLLESGGGLVQPGGSLRLSCAASGFTFGYDRMAWVRQAPGKGLEWVSSIDGPGGATYYADSVKGRFTISRDNSKNTLYLQMNSLRAEDTAVYYCAEGRRVPDFDYWGQGTLVTVSS

SEQ ID NO: 137 - protein, 119 aa, Artificial Sequence
  Description of Artificial Sequence: Synthetic polypeptide
EVQLLESGGGLVQPGGSLRLSCAASGFTFGEYEMTWVRQAPGKGLEWVSRIDPFGSETYYADSVKGRFTISRDNSKNTLYLQMNSLRAEDTAVYYCAEGVVPDLNFDYWGQGTLVTVSS

SEQ ID NO: 138 - protein, 120 aa, Artificial Sequence
  Description of Artificial Sequence: Synthetic polypeptide
EVQLLESGGGLVQPGGSLRLSCAASGFTFDKYVMGWVRQAPGKGLEWVSTIGSYGGATYYADSVKGRFTISRDNSKNTLYLQMNSLRAEDTAVYYCAKRLTLSATKFDYWGQGTLVTVSS

SEQ ID NO: 139 - protein, 120 aa, Artificial Sequence
  Description of Artificial Sequence: Synthetic polypeptide
EVQLLESGGGLVQPGGSLRLSCAASGFTFEDYVMGWVRQAPGKGLEWVSTIAHRGDITYYADSVKGRFTISRDNSKNTLYLQMNSLRAEDTAVYYCAKRRRLSDYRFDYWGQGTLVTVSS

SEQ ID NO: 140 - protein, 119 aa, Artificial Sequence
  Description of Artificial Sequence: Synthetic polypeptide
EVQLLESGGGLVQPGGSLRLSCAASGFTFGQFDMYWVRQAPGKGLEWVSAISPAGTGTYYADSVKGRFTISRDNSKNTLYLQMNSLRAEDTAVYYCAKAGDRSSLFDYRGQGTLVTVSS

SEQ ID NO: 141 - protein, 118 aa, Artificial Sequence
  Description of Artificial Sequence: Synthetic polypeptide
EVQLLESGGGLVQPGGSLRLSCAASGFTFKDTGMTWVRQAPGKGLEWVSSISSYGRDTYYADSVKGRFTISRDNSKNTLYLQMNSLRAEDAAVYYCAKLNAALGFDYWGQGTLVTVSS

SEQ ID NO: 142 - protein, 118 aa, Artificial Sequence
  Description of Artificial Sequence: Synthetic polypeptide
EVQLLESGGGLVQPGGSLRLSCAASGFTFGPYPMSWVRQAPGKGLEWVSGINAPGTRTYYADSVKGRFTISRDNSKNTLYLQMNSLRAEDTAVYYCAQQMSSGVFDYWGQGTLVTVSS

SEQ ID NO: 143 - protein, 118 aa, Artificial Sequence
  Description of Artificial Sequence: Synthetic polypeptide
EVQLLESGGGLVQPGGSLRLSCAASGFTFSNQDMTWVRQAPGKGLEWVSSIDSSGQLTYYADSVKGRFTISRDNSKNTLYLQMNSLRAEDTAVYYCAKVKSLARFDYWGQGTLVTVSS

SEQ ID NO: 144 - protein, 117 aa, Artificial Sequence
  Description of Artificial Sequence: Synthetic polypeptide
EVQLLESGGGLVQPGGSLRLSCAASGFTFPESDMKWVRQAPGKGLEWVSSISPNGWDTYYADSVKGRFTISRDNSKNTLYLQMNSLRAEDTAVYYCAKPAQVLFDYWGQGTLVTVSS

SEQ ID NO: 145 - protein, 120 aa, Artificial Sequence
  Description of Artificial Sequence: Synthetic polypeptide
EVQLLESGGGLVQPGGSLRLSCAASGFTFEQYVMGWVRQAPGKGLEWVSTIGTSGKYTYYADSVKGRFTISRDNSKNTLYLQMNSLRAEDTAVYYCAQRRSLTRVHFDYWGQGTLVTVSS

SEQ ID NO: 146 - protein, 119 aa, Artificial Sequence
  Description of Artificial Sequence: Synthetic polypeptide
EVQLLESGGGLVQPGGSLRLSCAASGFTFGVEHMSWVRQAPGKGLEWVSAITGDGDRTYYADSVKGRFTISRDNSKNTLYLQMNSLRAEDTAVYYCAKTVSWNGRFDYWGQGTLVTVSS

SEQ ID NO: 147 - protein, 117 aa, Artificial Sequence
  Description of Artificial Sequence: Synthetic polypeptide
EVQLLESGGGLVQPGGSLRLSCAASGFTFAWYNMGWVRQAPGKGLEWVSRIAPSGIITYYADSVKGRFTISRDNSKNTLYLQMNSLRAEDTAVYYCAKGLRGKFDYWGQGTLVTVSS

SEQ ID NO: 148 - protein, 116 aa, Artificial Sequence
  Description of Artificial Sequence: Synthetic polypeptide
EVQLLESGGGLVQPGGSLRLSCAASGFTFSNYEMRWVRQAPGKGLEWVSSISSAGTDTYYADSVKGRFTISRDNSKNTLYLQMNSLRAEDTAVYYCAKQSLNFDYWGQGTLVTVSS

SEQ ID NO: 149 - protein, 116 aa, Artificial Sequence
  Description of Artificial Sequence: Synthetic polypeptide
EVQLLESGGGLVQPGGSLRLSCVASGFTFDEEPMTWVRQAPGKGLEWVSIIDPGGGATYYADSVKGRFTISRDNSKNTLYLQMNSLRAEDTAVYYCAKSNSMFDYWGQGTLVTVSS

SEQ ID NO: 150 - protein, 121 aa, Artificial Sequence
  Description of Artificial Sequence: Synthetic polypeptide
EVQLLESGGGLVQPGGSLRLSCAASGFTFSAYPMHWVRQAPGKGLEWVSSIASSGITTYYADSVKGRFTISRDNSKNTLYLQMNSLRAEDTAVYYCAKFTRLHFPAQFDYWGQGTLVTVSS

SEQ ID NO: 151 - protein, 119 aa, Artificial Sequence
  Description of Artificial Sequence: Synthetic polypeptide
EVQLLESGGGLVQPGGSLRLSCAASGFTFADYAMGWVRQAPGKGLEWVSRISPEGSRTYYADSVKGRFTISRDNSKNTLYLQMNSLRAEDTAVYYCAKLRPYASKFDYWGQGTLVTVSS

SEQ ID NO: 152 - protein, 116 aa, Artificial Sequence
  Description of Artificial Sequence: Synthetic polypeptide
EVQLLESGGGLVQPGGSLRLSCAASGFTFRPYDMGWVRQAPGKGLEWVSTISHQGNRTYYADSVKGRFTISRDNSKNTLYLQMNSLRAEDTAVYYCAKVSHHFDYWGQGTLVTVSS

SEQ ID NO: 153 - protein, 118 aa, Artificial Sequence
  Description of Artificial Sequence: Synthetic polypeptide
EVQLLESGGGLVQPGGSLRLSCAASGFTFSAYNMWWARQAPGKGLEWVSWINSTGSRTYYADSVKGRFTISRDNSKNTLYLQMNSLRAEDTAVYYCAKNWHRGRFDYWGQGTLVTVSS

SEQ ID NO: 154 - protein, 117 aa, Artificial Sequence
  Description of Artificial Sequence: Synthetic polypeptide
EVQLLESGGGLVQPGGSLRLSCAASGFTFDRYRMGWVRQAPGKGLEWVSTINRLGQSTYYADSVKGRFTISRDNSKNTLYLQMNSLRAEDTAVYYCAKVKKHKFDYWGQGTLVTVSS

SEQ ID NO: 155 - protein, 117 aa, Artificial Sequence
  Description of Artificial Sequence: Synthetic polypeptide
EVQLLESGGGLVQPGGSLRLSCAASGFTFAHYNMRWVRQAPGKGLEWVSTITKTGFRTYYADSVKGRFTISRDNSKNTLYLQMNSLRAEDTAVYYCAKAGQFDFDYWGQGTLVTVSS

SEQ ID NO: 156 - protein, 118 aa, Artificial Sequence
  Description of Artificial Sequence: Synthetic polypeptide
EVQLLESGGGLVQPGGSLRLSCAASGFTFYPYSMHWVRQAPGKGLEWVSTIDGSGMFTYYADSVKGRFTISRDNSKNTLYLQMNSLRAEDTAVYYCAEDSLKASFDYWGQGTLVTVSS

SEQ ID NO: 157 - protein, 117 aa, Artificial Sequence
  Description of Artificial Sequence: Synthetic polypeptide
EVQLLESGGGLVQPGGSLRLSCAASGFTFPLYGMWWVRQAPGKGLEWVSYIGPYGHTTYYADSVKGRFTISRDNSKNTLYLQMNSLRAEDTAVYYCAKKRKKKFDYWGQGTLVTVSS

SEQ ID NO: 158 - protein, 117 aa, Artificial Sequence
  Description of Artificial Sequence: Synthetic polypeptide
EVQLLESGGGLVQPGGSLRLSCAASGFTFPRYRMSWVRQAPGKGLEWVSSITPYGAHTYYADSVKGRFTISRDNSKNTLYLQMNSLRAEDTAVYYCAKYGKWYFDYWGQGTLVTVSS

SEQ ID NO: 159 - protein, 117 aa, Artificial Sequence
  Description of Artificial Sequence: Synthetic polypeptide
EVQLLESGGGLVQPGGSLRLSCAASGFTFNEYAMRWVRQAPGKGLEWVSTIDRLGLHTYYADSVKGRFTISRDNSKNTLYLQMNSLRAEDTAVYYCAKSGPFTFDYWGQGTLVTVSS

SEQ ID NO: 160 - protein, 117 aa, Artificial Sequence
  Description of Artificial Sequence: Synthetic polypeptide
EVQLLESGGGLVQPGGSLRLSCAASGFTFERYNMRWVRQAPGKGLEWVSTIDRLGLATYYADSVKGRFTISRDNSKNTLYLQMNSLRAEDTAVYYCAKAGSWSFDYWGQGTLVTVSS

SEQ ID NO: 161 - protein, 118 aa, Artificial Sequence
  Description of Artificial Sequence: Synthetic polypeptide
EVQLLESGGGLVQPGGSLRLSCAASGFTFGIYDMKWVRQAPGKGLEWVSTISSSGTHTYYADSVKGRFTISRDNSKNTLYLQMNSLRAEDTAVYYCAKYPQPYPFDYWGQGTLVTVSS

SEQ ID NO: 162 - protein, 118 aa, Artificial Sequence
  Description of Artificial Sequence: Synthetic polypeptide
EVQLLESGGGLVQPGGSLRLSCAASGFTFWVYDMRWVRQAPGKGLEWVSTISATGVHTYYADSVKGRFTISRDNSKNTLYLQMNSLRAEDTAVYYCAKYPPAGRFDYWGQGTLVTVSS

SEQ ID NO: 163 - protein, 119 aa, Artificial Sequence
  Description of Artificial Sequence: Synthetic polypeptide
EVQLLESGGGLVQPGGSLRLSCAASGFTFSTYDMIWVRQAPGKGLEWVSAISPNGTGTYYADSVKGRFTISRDNSKNTLYLQMNSLRAEDTAVYYCAKPPQVNTEFDYRGQGTLVTVSS

SEQ ID NO: 164 - protein, 116 aa, Artificial Sequence
  Description of Artificial Sequence: Synthetic polypeptide
EVQLLESGGGLVQPGGSLRLSCAASGFTFEKEDMGWVRQAPGKGLEWVSHISPNGYATYYADSVKGRFTISRDNSKNTLYLQMNSLRAEDTAVYYCAKSWSSFDYWGQGTLVTVSS

SEQ ID NO: 165 - protein, 118 aa, Artificial Sequence
  Description of Artificial Sequence: Synthetic polypeptide
EVQLLESGGGLVQPGGSLRLSCAASGFTFSATPMEWARQAPGKGLEWVSTISESGYSTYYADSVKGRFTISRDNSKNTLYLQMNSLRAEDTAVYYCAKWNSTTGFDYWGQGTLVTVSS

SEQ ID NO: 166 - protein, 117 aa, Artificial Sequence
  Description of Artificial Sequence: Synthetic polypeptide
EVQLLESGGGLVQPGGSLRLSCAASGFTFNTVDMEWVRQAPGKGLEWVSSISPNGWDTYYADSVKGRFTISRDNSKNTLYLQMNSLRAEDTAVYYCAEAPHRAFDYWGQGTLVTVSS

SEQ ID NO: 167 - protein, 119 aa, Artificial Sequence
  Description of Artificial Sequence: Synthetic polypeptide
EVQLLESGGGLVQPGGSLRLSCAASGFTFEDKEMSWVRQAPGKGLEWVSRIDALGDSTYYADSVKGRFTISRDNSKNTLYLQMNSLRAEDTAVYYCAEGMVPRLKFDYWGQGTLVTVSS

SEQ ID NO: 168 - protein, 114 aa, Artificial Sequence
  Description of Artificial Sequence: Synthetic polypeptide
EVQLLESGGGLVQPGGSLRLSCAASGFTFSDHSMMWVRQAPGKGLEWVSDIEPHGVHTYYADSVKGRFTISRDNSKNTLYLQMNSLRAEDTAVYYCANPTFDYWGQGTLVTVSS

SEQ ID NO: 169 - protein, 122 aa, Artificial Sequence
  Description of Artificial Sequence: Synthetic polypeptide
EVQLLESGGGLVQPGGSLRLSCAASGFTFSPHTMHWVRQAPGKGLEWVSGIGPDGTTTYYADSVKGRFTISRDNSKNTLYLQMNSLRAEDTAVYYCAKRSYSWDRGWTFDYWGQGTLVTVSS

SEQ ID NO: 170 - protein, 119 aa, Artificial Sequence
  Description of Artificial Sequence: Synthetic polypeptide
EVQLLESGGGLVQPGGSLRLSCAASGFTFYASDMKWVRQAPGKGLEWVSSISPNGWDTYYADSVKGRFTISRDNSKNTLYLQMNSLRAEDTAVYYCAKADYTYHSFDYWGQGTLVTVSS

SEQ ID NO: 171 - protein, 117 aa, Artificial Sequence; identical to SEQ ID NO: 155
  Description of Artificial Sequence: Synthetic polypeptide

SEQ ID NO: 172 - protein, 118 aa, Artificial Sequence
  Description of Artificial Sequence: Synthetic polypeptide
EVQLLESGGGLVQPGGSLRLSCAASGFTFSHYHMGWARQAPGKGLEWVSVIGPRGISTYYADSVKGRFTISRDNSKNTLYLQMNSLRAEDTAVYYCAKSPSRHRFDYWGQGTLVTVSS

SEQ ID NO: 173 - protein, 117 aa, Artificial Sequence; identical to SEQ ID NO: 159
  Description of Artificial Sequence: Synthetic polypeptide

SEQ ID NO: 174 - protein, 123 aa, Artificial Sequence
  Description of Artificial Sequence: Synthetic polypeptide
EVQLLESGGGLVQPGGSLRLSCAASGFTFGNYSMKWARQAPGKGLEWVSTITPDGWYTYYADSVKGRFTISRDNSKNTLYLQMNSLRAEDTAVYYCAKVGDAVWGWIGGFDYWGQGTLVTVSS

SEQ ID NO: 175 - protein, 116 aa, Artificial Sequence
  Description of Artificial Sequence: Synthetic polypeptide
EVQLLESGGGLVQPGGSLRLSCAASGFTFGDYGMKWVRQAPGKGLEWVSAITSNGDFTYYADSVKGRFTISRDNSKNTLYLQMNSLRAEDTAVYYCAKSLYKFDYWGQGTLVTVSS

SEQ ID NO: 176 - protein, 123 aa, Artificial Sequence
  Description of Artificial Sequence: Synthetic polypeptide
EVQLLESGGGLVQPGGSLRLSCAGSGFTFPTYKMGWVRQAPGKGLEWVSFIDYWGWRTYYADSVKGRFTISRDNSKNTLYLQMNSLRAEDTAVYYCAKSPYSWTHDSPHFDYWGQGTLVTVSS

SEQ ID NO: 177 - protein, 116 aa, Artificial Sequence
  Description of Artificial Sequence: Synthetic polypeptide
EVQLLESGGGLVQPGGSLRLSCAASGFTFRPYTMCWARQAPGKGLEWVSCISDAGSFTYYADSVKGRFTISRDNSKNTLYLQMNSLRAEDTAVYYCAKRMSSFDYWGQGTLVTVSS

SEQ ID NO: 178 - protein, 122 aa, Artificial Sequence
  Description of Artificial Sequence: Synthetic polypeptide
EVQLLESGGGLVQPGGSLRLSCAASGFTFQNYQMAWVRQAPGKGLEWVSTISGTGKNTYYADSVKGRFTISRDNSKNTLYLQMNSLRAEDTAVYYCAKTPQNYFSVRRFDYWGQGTLVTVSS

SEQ ID NO: 179 - protein, 118 aa, Artificial Sequence
  Description of Artificial Sequence: Synthetic polypeptide
EVQLLESGGGLVQPGGSLRLSCAASGFTFGAYTMGWVRQAPGKGLEWVSKISTSGGQTYYADSVKGRFTISRDNSKNTLYLQMNSLRAEDTAVYYCAKPLNWWAFDYWGQGTLVTVSS

SEQ ID NO: 180 - protein, 117 aa, Artificial Sequence
  Description of Artificial Sequence: Synthetic polypeptide
EVQLLESGGGLVQPGGSLRLSCAASGFTFNAYPMTWVRQAPGKGLEWVSRIDGYGRHTYYADSVKGRFTISRDNSKNTLYLQMNSLRAEDTAVYYCAKGIIPNFDYWGQGTLVTVSS

SEQ ID NO: 181 - protein, 119 aa, Artificial Sequence
  Description of Artificial Sequence: Synthetic polypeptide
EVQLLESGGGLVQPGGSLRLSCAASGFTFGAVDMTWVRQAPGKGLEWVSAISPSGSATYYADSVKGRFTISRDNSKNTLYLQMNSLRAEDTAVYYCAKGRVPDLGFDYWGQGTLVTVSS

SEQ ID NO: 182 - protein, 117 aa, Artificial Sequence
  Description of Artificial Sequence: Synthetic polypeptide
EVQLLESGGGLVQPGGSLRLSCAASGFTFDSYAMGWARQAPGKGLEWVSAIGAKGLSTYYADSVKGRFTISRDNSKNTLYLQMNSLRAEDTAVYYCAKAARGKFDYWGQGTLVTVSS

SEQ ID NO: 183 - protein, 116 aa, Artificial Sequence
  Description of Artificial Sequence: Synthetic polypeptide
EVQLLESGGGLVQPGGSLRLSCAASGFTFTRYQMGWVRQAPGKGLEWVSVINVWGSSTYYADSVKGRFTISRDNSKNTLYLQMNSLRAEDTAVYYCAKMSGKFAYWGQGTLVTVSS

SEQ ID NO: 184 - protein, 117 aa, Artificial Sequence
  Description of Artificial Sequence: Synthetic polypeptide
EVQLLESGGGLVQPGGSLRLSCAASGFTFGNYSMMWVRQAPGKGLEWVSTIIPAGTSTYYADSVKGRFTISRDNSKNTLYLQMNSLRAEDTAVYYCAKPSIRLFDYWGQGTLVTVSS

SEQ ID NO: 185 - protein, 116 aa, Artificial Sequence
  Description of Artificial Sequence: Synthetic polypeptide
EVQLLESGGGLVQPGGSLRLSCAASGFTFGAYDMGWVRQAPGKGLEWVSWISPNGYDTYYADSVKGRFTISRDNSKNTLYLQMNSLRAEDTAVYYCAKGGVKFDYWGQGTLVTVSS

SEQ ID NO: 186 - protein, 123 aa, Artificial Sequence
  Description of Artificial Sequence: Synthetic polypeptide
EVQLLESGGGLVQPGGSLRLSCAASGFTFVWYEMAWVRQAPGKGLEWVSTIQADGEQTYYADSVKGRFTISRDNSKNTLYLQMNSLRAEDTAVYYCAKASYALVYPPEEFDYWGQGTLVTVSS

SEQ ID NO: 187 - protein, 122 aa, Artificial Sequence
  Description of Artificial Sequence: Synthetic polypeptide
EVQLLESGGGLVQPGGSLRLSCAASGFTFTNYRMSWVRQAPGKGLEWVSAIDDLGVSTYYADSVKGRFTISRDNSKNTLYLQMNSLRAEDTAVYYCAKWRLKNSQPTDFDYWGQGTLVTVSS

SEQ ID NO: 188 - protein, 119 aa, Artificial Sequence
  Description of Artificial Sequence: Synthetic polypeptide
EVQLLESGGGLVQPGGSLRLSCAASGFTFDQAHMWWVRQAPGKGLEWVSFINPSGYYTYYADSVKGRFTISRDNSKNTLYLQMNSLRAEDTAVYYCAKPSLSPSSFDYWGQGTLVTVSS

SEQ ID NO: 189 - protein, 118 aa, Artificial Sequence
  Description of Artificial Sequence: Synthetic polypeptide
EVQLLESGGGLVQPGGSLRLSCAASGFTFETGQMGWARQAPGKGLEWVSNIDGSGTYTYYADSVKGRFTISRDNSKNTLYLQMNSLRAEDTAVYYCAKSTQNYRFDYWGQGTLVTVSS

SEQ ID NO: 190 - protein, 119 aa, Artificial Sequence
  Description of Artificial Sequence: Synthetic polypeptide
EVQLLESGGGLVQPGGSLRLSCAASGFTFGAYPMYWVRQAPGKGLEWVSSIHKDGRITYYADSVKGRFTISRDNSKNTLYLQMNSLRAEDTAVYYCAKQGTPVDGFDYWGQGTLVTVSS

SEQ ID NO: 191 - protein, 121 aa, Artificial Sequence
  Description of Artificial Sequence: Synthetic polypeptide
EVQLLESGGGLVQPGGSLRLSCAASGFTFPDEGMTWVRQAPGKGLEWVSTIETGGTVTYYADSVKGRFTISRDNSKNTLYLQMNSLRAEDTAVYYCAKMDGSGTWQTFDYWGQGTLVTVSS

SEQ ID NO: 192 - protein, 116 aa, Artificial Sequence
  Description of Artificial Sequence: Synthetic polypeptide
EVQLLESGGGLVQPGGSLRLSCAASGFTFDSLGMGWARQAPGKGLEWVSYIRAEGAYTYYADSVKGRFTISRDNSKNTLYLQMNSLRAEDTAVYYCAKYLADSDYWGQGTLVTVSS

SEQ ID NO: 193 - protein, 120 aa, Artificial Sequence
  Description of Artificial Sequence: Synthetic polypeptide
EVQLLESGGGLVQPGGSLRLSCAASGFTFSESYMEWVRQAPGKGLEWVSGIDHIGGGTYYADSVKGRFTISRDNSKNTLYLQMNSLRAEDTAVYYCAKDDGRGGSMFDYWGQGTLVTVSS

SEQ ID NO: 194 - protein, 116 aa, Artificial Sequence
  Description of Artificial Sequence: Synthetic polypeptide
EVQLLESGGGLVQPGGSLRLSCAASGFTFSGGYMWWVRQAPGKGLEWVSSIGASGAYTYYADSVKGRFTISRDNSKNTLYLQMNSLRAEDTAVYYCAKTGGRLDYWGQGTLVTVSS

SEQ ID NO: 195 - protein, 119 aa, Artificial Sequence
  Description of Artificial Sequence: Synthetic polypeptide
EVQLLESGGGLVQPGGSLRLSCAASGFTFDEGHMGWVRQAPGKDLEWVSYIGSLGLHTYYADSVKGRFTISRDNSKNTLYLQMNSLRAEDTAVYYCAKREFSNGGFDYWGQGTLVTVSS

SEQ ID NO: 196 - protein, 121 aa, Artificial Sequence
  Description of Artificial Sequence: Synthetic polypeptide
EVQLLESGGGLVQPGGSLRLSCAASGFTFKTSPMYWVRQAPGKGLEWVSSIDRTGGHTYYADSVKGRFTISRDNSKNTLYLQMNSLRAEDTAVYYCAKQALLTDAKRFDYWGQGTLVTVSS

SEQ ID NO: 197 - protein, 120 aa, Artificial Sequence
  Description of Artificial Sequence: Synthetic polypeptide
EVQLLESGGGLVQPGGSLRLSCAASGFTFDGRDMVWVRQAPGKGLEWVSAISPSGLDTYYADSVKGRFTISRDNSKNTLYLQMNSLRAEDTAVYYCAERPQMLVTNFDYWGQGTLVTVSS

SEQ ID NO: 198 - protein, 119 aa, Artificial Sequence
  Description of Artificial Sequence: Synthetic polypeptide
EVQLLESGGGLVQPGGSLRLSCAASGFTFGNDPMSWVRQAPGKGLEWVSGIGREGDSTYYADSVKGRFTISRDNSKNTLYLQMNSLRAEDTAVYYCAKDSMRHQPFDYWGQGTLVTVSS

SEQ ID NO: 199 - protein, 119 aa, Artificial Sequence
  Description of Artificial Sequence: Synthetic polypeptide
EVQLLESGGGLVQPGGSLRLSCAASGFTFDETYMKWVRQAPGKGLEWVSAIGASGADTYYADSVKGRFTISRDNSKNTLYLQMNSLRAEDTAVYYCAKFTHLNGRFDYWGQGTLVTVSS

SEQ ID NO: 200 - protein, 119 aa, Artificial Sequence
  Description of Artificial Sequence: Synthetic polypeptide
EVQLLESGGGLVQPGGSLRLSCAASGFTFGGWPMGWVRQAPGKGLEWVSGIDIDGAPTYYADSVKGRFTISRDNSKNTLYLQMNSLRAEDTAVYYCAKEEAGSWSFDYWGQGTLVTVSS

SEQ ID NO: 201 - protein, 116 aa, Artificial Sequence
  Description of Artificial Sequence: Synthetic polypeptide
EVQLLESGGGLVQPGGSLRLSCAASGFTFSDQAMWWARQAPGKGLEWVSFIQGDGGFTYYADSVKGRFTISRDNSKNTLYLQMNSLRAEDTAVYYCAKPSKPFDYWGQGTLVTVSS

SEQ ID NO: 202 - protein, 118 aa, Artificial Sequence
  Description of Artificial Sequence: Synthetic polypeptide
EVQLLESGGGLVQPGGSLRLSCAASGFTFETGQMGWARQAPGKGLEWVSNIDGSGTYTYYADSVKGRFTISRDNSKNTLYLQMNSLRAEDTAVYYCAKAVRNFAFDYWGQGTLVTVSS

SEQ ID NO: 203 - protein, 124 aa, Artificial Sequence
  Description of Artificial Sequence: Synthetic polypeptide
EVQLLESGGGLVQPGGSLRLSCAASGFTFSGHDMSWVRQAPGKGLEWVSAISPHGTHTYYADSVKGRFTISRDNSKNTLYLQMNSLRAEDTAVYYCAKGIRGWIGHDTQPFDYWGQGTLVTVSS

SEQ ID NO: 204 - protein, 119 aa, Artificial Sequence
  Description of Artificial Sequence: Synthetic polypeptide
EVQLLESGGGLVQPGGSLRLSCAASGFTFESKDMLWVRQAPGKGLEWVSSISSDGTHTYYADSVKGRFTISRDNSKNTLYLQMNSLRAEDTAVYYCAQELGGSWQFDYWGQGTLVTVSS

SEQ ID NO: 205 - protein, 122 aa, Artificial Sequence
  Description of Artificial Sequence: Synthetic polypeptide
EVQLLESGGGLVQPGGSLRLSCAASGFTFADRDMVWVRQAPGKGLEWVSGIGASGTSTYYADSVKGRFTISRDNSKNTLYLQMNSLRAEDAAVYYCAKGGTGPTDLWDFDYWGQGTLVTVSS

SEQ ID NO: 206 - protein, 119 aa, Artificial Sequence
  Description of Artificial Sequence: Synthetic polypeptide
EVQLLESGGGLVQPGGSLRLSCAASGFTFDDEKMLWVRQAPGKGLEWVSSISVSGLHTYYADSVKGRFTISRDNSKNTLYLQMNSLRAEDTAVYYCAKEEAGSWSFDYWGQGTLVTVSS

SEQ ID NO: 207 - protein, 119 aa, Artificial Sequence
  Description of Artificial Sequence: Synthetic polypeptide
EVQLLESGGGLVQPGGSLRLSCAASGFTFGQERMIWVRQAPGKGLEWVSDISASGGTTYYADSVKGRFTISRDNSKNTLYLQMNSLRAEDTAVYYCAKEEAGSWSFDYWGQGTLVTVSS

SEQ ID NO: 208 - protein, 116 aa, Artificial Sequence
  Description of Artificial Sequence: Synthetic polypeptide
EVQLLESGGGLVQPGGSLRLSCAASGFTFEWYEMQWVRQAPGKGLEWVSAISGDGYRTYYADSVKGRFTISRDNSMNTLYLQMNSLRAEDTAVYYCAKELGYFDYRGRGTLVTVSS

SEQ ID NO: 209 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELGYFDYWGRGTLVTVSS

SEQ ID NO: 210 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELGYFDYRVQGTLVTVSS

SEQ ID NO: 211 - protein, 116 aa, Artificial Sequence
  Description of Artificial Sequence: Synthetic polypeptide
EVQLLESGGGLVQPGGSLRLSCAASGFTFEWYEMQWVRKAPGKGLEWVSAISGDGYRTYYADSVKGRFTISRDNSKNTLYLQMNSLRAEDTAVYYCAKELGYFDYWGRGTLVTVSS

SEQ ID NO: 212 - protein, 116 aa, Artificial Sequence
  Description of Artificial Sequence: Synthetic polypeptide
EVQLLESGGGLVQPGGSLRLSCAASGFTFEWYEMQWVRQAPGKGLEWISAISGDGYRTYYADSVKGRFTISRDNSKNTLYLQMNSLRAEDTAVYYCAKELGYFDYRVQGTLVTVSS

SEQ ID NO: 213 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSENTLYLQMNSLRAEDTAVYYCAKELGYFDYWGRGTLVTVSS

SEQ ID NO: 214 - protein, 116 aa, Artificial Sequence
  Description of Artificial Sequence: Synthetic polypeptide
EVQLLETGGGLVQPGGSLRLSCAASGFTFEWYEMQWVRRAPGKGLEWVSAISGDGYRTYYADSVKGRFTISRDNSKNTLYLQMDSLRAEDTAVYYCAKELGYFDYWGRGTLVTVTS

SEQ ID NO: 215 - protein, 116 aa, Artificial Sequence
  Description of Artificial Sequence: Synthetic polypeptide
EVQLLESGGGLVQPGGSLRLSCAASGFTFEWYEMQWVRQAPGKGLEWVSAISGDGYRTYYADSVKGRFTISRDNSKNTLYLQMNSLRAEDTAVYYCAKELGYFHYWGRGTLVTVSS

SEQ ID NO: 216 - protein, 116 aa, Artificial Sequence
  Description of Artificial Sequence: Synthetic polypeptide
EVQLLESGGGLVQPGGSLRLSCVASGFTFEWYEMQWVRQAPGNGLEWISAISGDGYRTYYADSVKGRFTISRDNSKNTLYLQMNSLRAEDTAVYYCAKELGYFDYWGRGTLVTVSS

SEQ ID NO: 217 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLLMNSLRAEDTAVYYCAKELGYFDYWGRGTLVTVSS

SEQ ID NO: 218 - protein, 116 aa, Artificial Sequence
  Description of Artificial Sequence: Synthetic polypeptide
EVQLLESGGGLVQPGGSLRLSCAASGFTFEWYEMQWVRKAPGKGLEWVSAISGDGYRTYYADSVKGRFTISRDNSKNTLYLQMNSLRAEDTAVYYCAKELGYFDYRGRGTLVTVSS

SEQ ID NO: 219 - protein, 116 aa, Artificial Sequence
  Description of Artificial Sequence: Synthetic polypeptide
EVQLLESGGGLVQPGGSMRLSCAASGFTFEWYEMQWVRRAPGKGLEWVSAISGDGYRTYYADSVKGRFTISRDNSKNTLYLQMNSLRAEDTAVYYCAKELGYFDYRGRGTLVTVSS

SEQ ID NO: 220 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSMISGDGYRTYYADSVKGRFTISRDNSKNTLYLQMNSLRAEDTAVYYCAKELGYFDYWGRGTLVTVSS

SEQ ID NO: 221 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGWRTYYADSVKGRFTISRDNSKNTLYLQMNSLRAEDTAVYYCAKELGYFDYWGRGTLVTVSS

SEQ ID NO: 222 - protein, 116 aa, Artificial Sequence
  Description of Artificial Sequence: Synthetic polypeptide
EVQLLESGGGLVQPGGSLRLSCAASGFTFGWYEMQWVRRAPGKGLEWVSAISGDGYRTYYADSVKGRFTISRDNSKNTLYLQMNSLRAEDTAVYYCAKELLYFDYWGRGTLVTVSS

SEQ ID NO: 223 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELGFFDYWGRGTLVTVSS

SEQ ID NO: 224 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELEYFDYWGRGTLVTVSS

SEQ ID NO: 225 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKGLEYFDYWGRGTLVTVSS

SEQ ID NO: 226 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELAFFDYWGRGTLVTVSS

SEQ ID NO: 227 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELLYFDYWGRGTLVTVSS

SEQ ID NO: 228 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELEFFDYWGRGTLVTVSS

SEQ ID NO: 229 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELQFFDYWGRGTLVTVSS

SEQ ID NO: 230 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELLFFDYWGRGTLVTVSS

SEQ ID NO: 231 - protein, 116 aa, Artificial Sequence
  Description of Artificial Sequence: Synthetic polypeptide
EVQLLESGGGLVRPGGSLRLSCAASGFTFEWYEMQWVRRAPGKGLEWVSAISGDGYRTYYADSVKGRFTISRDNSKNTLYLQMNSLRAEDTAVYYCAKELEFFDYWGRGTLVTVSS

SEQ ID NO: 232 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELLFFDYRGRGTLVTVSS

SEQ ID NO: 233 - protein, 116 aa, Artificial Sequence
  Description of Artificial Sequence: Synthetic polypeptide
EVQLLESGGGLVQPGGSLRLSCAASGFIFEWYEMQWVRRAPGKGLEWVSAISGDGYRTYYADSVKGRFTISRDNSKNTLYLQMNSLRAEDTAVYYCAKNLEYFDYWGRGTLVTVSS

SEQ ID NO: 234 - protein, 116 aa, Artificial Sequence
  Description of Artificial Sequence: Synthetic polypeptide
EVRLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELQFFDYWGRGTLVTVSS

SEQ ID NO: 235 - protein, 116 aa, Artificial Sequence
  Description of Artificial Sequence: Synthetic polypeptide
EVQLLGSGGGLVQPGGSLRLSCAASGFTFEEEEMIWVRQAPGKGLEWVSAISGSGGSTYYADSVKGRFTISRDNSKNTLYLQMNSLRAEDTAVYYCSKEPFRFDYWGQGTLVTVSS

SEQ ID NO: 236 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFRYDYWGQGTLVTVSS

SEQ ID NO: 237 - protein, 116 aa, Artificial Sequence
  Description of Artificial Sequence: Synthetic polypeptide
EVQLLASGGGLVQPGGSLRLSCAASGFTFEEEEMIWVRQAPGKGLEWISAISGSGGSTYYADSVKGRFTISRDNSKNTLYLQMNSLRAEDTAVYYCGKEPFRFDYWGQGTLVTVSS

SEQ ID NO: 238 - protein, 116 aa, Artificial Sequence
  Description of Artificial Sequence: Synthetic polypeptide
EVQLLDPGGGLVQPGGSLRLSCAASGFTFGKEEMIWVRQAPGKGLEWVSSISGSGGSTYYADSVKGRFTISRDNSRNTLYLQMNSLRAEDTAVYYCGKEPFRFDYWGQGTLVTVSS

SEQ ID NO: 239 - protein, 116 aa, Artificial Sequence
  Description of Artificial Sequence: Synthetic polypeptide
EVQLLGSGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFRFDYWGQGTLVTVSS

SEQ ID NO: 240 - protein, 116 aa, Artificial Sequence
  Description of Artificial Sequence: Synthetic polypeptide
EVQLLEPGGGLVQPGGSLRLSCAASGFTFEEEEMIWVRQAPGKGLEWVSAISGSGGSTYYADSVKGRFTISRDNSKNTLYLLMNSLRAEDTAVYYCSKEPFRFDYWGQGALVTVSS

SEQ ID NO: 241 - protein, 116 aa, Artificial Sequence
  Description of Artificial Sequence: Synthetic polypeptide
EVQLLDPGGGLVQPGGSLRLSCAASGFTFGKEEMIWVRQAPGKGLEWVSSISGSGGSTYYADSVKGRFTISRDNSKNTLYLQMNSLRAEDTAVYYCAKEPLRFDYWGQGTLVTVSS

SEQ ID NO: 242 - protein, 116 aa, Artificial Sequence
  Description of Artificial Sequence: Synthetic polypeptide
EVQLLESGGGLVQPGGSLRLSCAASGFTFEEEEMIWVRQAPGKGLEWISAISGSGGSTYYADSVKGRFTIHRDNSKNTLYLQMNSLRAEDTAVYYCSKEPFRFDYRGLGTLVTVSS

SEQ ID NO: 243 - protein, 116 aa, Artificial Sequence
  Description of Artificial Sequence: Synthetic polypeptide
EVQLLDPGGGLVQPGGSLRLSCAASGFTFGKEEMIWVRQAPGKGLEWVSSISGSGGSTYYADSVKGRFTISRDNSRNTLYLQMNSLRAEDTAVYYCAKEPLRFDYWGQGTLVTVSS

SEQ ID NO: 244 - protein, 116 aa, Artificial Sequence
  Description of Artificial Sequence: Synthetic polypeptide
EVQLLDSGGGFVQPGGSLRLSCAASGFTFEEEEMIWVRQAPGKGLEWISAISGSGGSTYYADSVKGRFTISRDNSKNTLYLQMNSLRAEDTAVYYCAKEPFRFDYWGQGTLVTVSS

SEQ ID NO: 245 - protein, 116 aa, Artificial Sequence
  Description of Artificial Sequence: Synthetic polypeptide
EVQLLDPGGGLVQPGGSLRLSCAASGFTFEEEEMIWVRQAPGKGLEWISAISGSGGSTYYADSVKGRFTISRDNSNNTLYLQMNSLRAEDTAVYYCGREPFRFDYWGQGTLVTVSS

SEQ ID NO: 246 - protein, 116 aa, Artificial Sequence
  Description of Artificial Sequence: Synthetic polypeptide
EVRLLESGEGLVQPGGSLRLSCAASGFTFEEEEMIWVRQAPGKGLEWVSAISGSGGSTYYADSVKGRFTISRDNSKNTLYLQMNSLRAEDTAVYYCGKEPFRFDYWGQGTLVTVSS

SEQ ID NO: 247 - protein, 116 aa, Artificial Sequence
  Description of Artificial Sequence: Synthetic polypeptide
EVQQLESGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFRFDYWGQGTLVTVSS

SEQ ID NO: 248 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFYYDYWGQGTLVTVSS

SEQ ID NO: 249 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFYFDYWGQGTLVTVSS

SEQ ID NO: 250 - protein, 116 aa, Artificial Sequence
  Description of Artificial Sequence: Synthetic polypeptide
EVQLLASGGGLVQPGGSLRLSCAASGFTFEEKEMIWVRQAPGKGLEWVSAISGSGGSTYYADSVKGRFTISRDNSKNTLYLQMNSLRAEDTAVYYCGKEPFFYDYWGQGTLVTVSS

SEQ ID NO: 251 - protein, 116 aa, Artificial Sequence
  Description of Artificial Sequence: Synthetic polypeptide
EVQLLASGGGLVQPGGSLRLSCAASGFTFPQEEMIWVRQAPGKGLEWVSAISGSGGSTYYADSVKGRFTISRDNSKNTLYLQMNSLRAEDTAVYYCGKEPFRYDYWGQGTLVTVSS

SEQ ID NO: 252 - protein, 116 aa, Artificial Sequence
  Description of Artificial Sequence: Synthetic polypeptide
EVQLLASGGGLVQPGGSLRLSCAASGFTFFAAEMIWVRQAPGKGLEWVSAISGSGGSTYYADSVKGRFTISRDNSKNTLYLQMNSLRAEDTAVYYCGKEPFRYDYWGQGTLVTVSS

SEQ ID NO: 253 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRPGTSTYYADSVKGRFTISRDNSKNTLYLQMNSLRAEDTAVYYCGKEPFRYDYWGQGTLVTVSS

SEQ ID NO: 254 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRMGFSTYYADSVKGRFTISRDNSKNTLYLQMNSLRAEDTAVYYCGKEPFRYDYWGQGTLVTVSS

SEQ ID NO: 255 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRWGHSTYYADSVKGRFTISRDNSKNTLYLQMNSLRAEDTAVYYCGKEPFRYDYWGQGTLVTVSS

SEQ ID NO: 256 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRLGWSTYYADSVKGRFTISRDNSKNTLYLQMNSLRAEDTAVYYCGKEPFRYDYWGQGTLVTVSS

SEQ ID NO: 257 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRWGASTYYADSVKGRFTISRDNSKNTLYLQMNSLRAEDTAVYYCGKEPFRYDYWGQGTLVTVSS

SEQ ID NO: 258 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRQGGSTYYADSVKGRFTISRDNSKNTLYLQMNSLRAEDTAVYYCGKEPFRYDYWGQGTLVTVSS

SEQ ID NO: 259 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISVSGWSTYYADSVKGRFTISRDNSKNTLYLQMNSLRAEDTAVYYCGKEPFRYDYWGQGTLVTVSS

SEQ ID NO: 260 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRWGWSTYYADSVKGRFTISRDNSKNTLYLQMNSLRAEDTAVYYCGKEPFRYDYWGQGTLVTVSS

SEQ ID NO: 261 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRNGLSTYYADSVKGRFTISRDNSKNTLYLQMNSLRAEDTAVYYCGKEPFRYDYWGQGTLVTVSS

SEQ ID NO: 262 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGLGWSTYYADSVKGRFTISRDNSKNTLYLQMNSLRAEDTAVYYCGKEPFRYDYWGQGTLVTVSS

SEQ ID NO: 263 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISALGWSTYYADSVKGRFTISRDNSKNTLYLQMNSLRAEDTAVYYCGKEPFRYDYWGQGTLVTVSS

SEQ ID NO: 264 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRRGYSTYYADSVKGRFTISRDNSKNTLYLQMNSLRAEDTAVYYCGKEPFRYDYWGQGTLVTVSS

SEQ ID NO: 265 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRHGWSTYYADSVKGRFTISRDNSKNTLYLQMNSLRAEDTAVYYCGKEPFRYDYWGQGTLVTVSS

SEQ ID NO: 266 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSSISRSGGSTYYADSVKGRFTISRDNSKNTLYLQMNSLRAEDTAVYYCGKEPFRYDYWGQGTLVTVSS

SEQ ID NO: 267 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRIGNSTYYADSVKGRFTISRDNSKNTLYLQMNSLRAEDTAVYYCGKEPFRYDYWGQGTLVTVSS

SEQ ID NO: 268 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGHGWSTYYADSVKGRFTISRDNSKNTLYLQMNSLRAEDTAVYYCGKEPFRYDYWGQGTLVTVSS

SEQ ID NO: 269 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRWGGSTYYADSVKGRFTISRDNSKNTLYLQMNSLRAEDTAVYYCGKEPFRYDYWGQGTLVTVSS

SEQ ID NO: 270 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFMYDYWGQGTLVTVSS

SEQ ID NO: 271 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFPYDYWGQGTLVTVSS

SEQ ID NO: 272 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGGTYYADSVKGRFTISRDNSKNTLYLQMNSLRAEDTAVYYCGKEPFRYDYWGQGTLVTVSS

SEQ ID NO: 273 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPLYYDYWGQGTLVTVSS

SEQ ID NO: 274 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPMYYDYWGQGTLVTVSS

SEQ ID NO: 275 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRNGFSTYYADSVKGRFTISRDNSKNTLYLQMNSLRAEDTAVYYCGKEPFRYDYWGQGTLVTVSS

SEQ ID NO: 276 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRTGGSTYYADSVKGRFTISRDNSKNTLYLQMNSLRAEDTAVYYCGKEPFRYDYWGQGTLVTVSS

SEQ ID NO: 277 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISREGGSTYYADSVKGRFTISRDNSKNTLYLQMNSLRAEDTAVYYCGKEPFRYDYWGQGTLVTVSS

SEQ ID NO: 278 - protein, 116 aa, Artificial Sequence
  Description of Artificial Sequence: Synthetic polypeptide
EVQLLASGGGLVQPGGSLRLSCAASGFPFEEEEMIWVRQAPGKGLEWVSAISRQGWSTYYADSVKGRFTISRDNSKNTLYLQMNSLRAEDTAVYYCGKEPFRYDYWGQGTLVTVSS

SEQ ID NO: 279 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRGGGSTYYADSVKGRFTISRDNSKNTLYLQMNSLRAEDTAVYYCGKEPFRYDYWGQGTLVTVSS

SEQ ID NO: 280 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRTGYSTYYADSVKGRFTISRDNSKNTLYLQMNSLRAEDTAVYYCGKEPFRYDYWGQGTLVTVSS

SEQ ID NO: 281 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRNGRSTYYADSVKGRFTISRDNSKNTLYLQMNSLRAEDTAVYYCGKEPFRYDYWGQGTLVTVSS

SEQ ID NO: 282 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSS

SEQ ID NO: 283 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRKGSSTYYADSVKGRFTISRDNSKNTLYLQMNSLRAEDTAVYYCGKEPFRYDYWGQGTLVTVSS

SEQ ID NO: 284 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRGGWSTYYADSVKGRFTISRDNSKNTLYLQMNSLRAEDTAVYYCGKEPFRYDYWGQGTLVTVSS

SEQ ID NO: 285 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRSGYSTYYADSVKGRFTISRDNSKNTLYLQMNSLRAEDTAVYYCGKEPFRYDYWGQGTLVTVSS

SEQ ID NO: 286 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRNGMSTYYADSVKGRFTISRDNSKNTLYLQMNSLRAEDTAVYYCGKEPFRYDYWGQGTLVTVSS

SEQ ID NO: 287 - protein, 116 aa, Artificial Sequence
  Description of Artificial Sequence: Synthetic polypeptide
EVQLLESGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSS

SEQ ID NO: 288 - protein, 116 aa, Artificial Sequence
  Description of Artificial Sequence: Synthetic polypeptide
EVQLLESGEGLVQPGGSLRLSCAASGFTFTEHEMIWVRQAPGKGLEWVSSISGNGANTYYADSVKGRFTISRDNSKNTLYLQMNSLRPEDTAVYYCAKEPLRFDYWGQGTLVTVSS

SEQ ID NO: 289 - protein, 116 aa, Artificial Sequence
  Description of Artificial Sequence: Synthetic polypeptide
EVQLLESGGGLVQPGGSLRLSCAASGSTFTEYEMIWVRQAPGKGLEWISSISGNGANTYYADSVKGRFTISRDNSKNTLYLQMNSLRAEDTAVYFCAKEPLRFDYRGQGTLVTVSS

SEQ ID NO: 290 - protein, 116 aa, Artificial Sequence
  Description of Artificial Sequence: Synthetic polypeptide
EVQLLEPGGGLVQPGGSLRLSCAASGFTFTEYEMIWVRKAPGKGMEWVSSISGNGANTYYADSVKGRFTISRDNSKNMLYLQMNSLRAEDTAVYYCAKEPLRFGYWGQGTLVTVSS

SEQ ID NO: 291 - protein, 116 aa, Artificial Sequence
  Description of Artificial Sequence: Synthetic polypeptide
EVQLLDSGGGLVQPGGSLRLSCAASGFTFTEYEMIWVRQAPGKGLEWVSSISGNGANTYYADSVKGRFTISRDNSKNTLYLQMNSLRAEDTAVYYCAKEPLRFDYWGRGTLVTVSS

SEQ ID NO: 292 - protein, 116 aa, Artificial Sequence
  Description of Artificial Sequence: Synthetic polypeptide
EVQLLGSGGGLVQPGGSLRLSCAASGFTFTEYEMIWVRQAPGKSLEWVSSISGNGANTYYADSVKGRFTISRDNSKNTLYLQMNSLRAEDTAVYYCAKEPLRYDDWGQGTLVTVSS

SEQ ID NO: 293 - protein, 116 aa, Artificial Sequence
  Description of Artificial Sequence: Synthetic polypeptide
EVQPLESGGGLVQPGGSLRLSCSASGFTFNEYEMIWVRQAPGKGLEWVSSISGNGANTYYADSVKGRFTISRDNSKNTLYLQMNSLRAEDTAVYYCAKEPLRFDYWGQGTLVTVSS

SEQ ID NO: 294 - protein, 116 aa, Artificial Sequence
  Description of Artificial Sequence: Synthetic polypeptide
EVQLLESGEGLVQPGGSLRLSCAASGFTFAEYEMIWVRQAPGKGLEWVSSISGNGANTYYADSVKGRFTISRDNSKNTLYLQMNSLRAEDTAVYYCAKEPLRFDYWGQGTLVTVSS

SEQ ID NO: 295 - protein, 116 aa, Artificial Sequence
  Description of Artificial Sequence: Synthetic polypeptide
EVQLLDPGGGLVQPGGSLRLSCAASGFTFTESEMIWVRQAPGKGLEWVSSISGNGANTYYADSVKGRFTISRDNSKNTLYLQMNSLRAEDTAVYYCAKEPLRFDYWGQGTLVTVSS

SEQ ID NO: 296 - protein, 116 aa, Artificial Sequence
  Description of Artificial Sequence: Synthetic polypeptide
EVQLLEPGGGLVQPGGSLRLSCAASGFTFTEYEMIWVRKAPGKGMEWVSSISGNGANTYYADSVKGRFTISRDNSKNTLYLQMNSLRPEDTAVYYCAKEPLRFDDWGQGTLVTVSS

SEQ ID NO: 297 - protein, 116 aa, Artificial Sequence
  Description of Artificial Sequence: Synthetic polypeptide
EVQLLESGVGLVQPGGSLRLSCAASGFTFTEYEMIWVRKAPGKGLEWVSSISGNGANTYYADSVKGRFTISRDNSKNTLYLQMNSLRAEDTAVYYCAKEPLRFDNWGQGTLVTVSS

SEQ ID NO: 298 - protein, 116 aa, Artificial Sequence
  Description of Artificial Sequence: Synthetic polypeptide
EVQLLESRGGLVQPGGSLRLSCAASGFTFTEHEMIWVRQAPGKGLEWVSSISGNGANTYYADSVKGRFSVSRDNSKNTLYLQMNSLRAEDTAVYYCAKEPLRFDYWGQGTLVTVSS

SEQ ID NO: 299 - protein, 116 aa, Artificial Sequence
  Description of Artificial Sequence: Synthetic polypeptide
EVQPLESGGGLVQPGGSLRLSCAASGFTFTEYEMIWVRQAPGKGLEWVSSISGNGANTYYADSVKGRFTISRDNSKNTLYLQMNSLRAEDTAVYYCAKEPLRFDYWGQGTLVTVSS

SEQ ID NO: 300 - protein, 116 aa, Artificial Sequence
  Description of Artificial Sequence: Synthetic polypeptide
EVQLLESAGGLVQPGGSLRLSCAASGFTFAEYEMIWVRQAPGKGLEWVSSISGNGANTYYADSVKGRFTISRDNSKNTLYLQMNSLRAEDTAVYYCAKEPLRFDYWGQGALVTVSS

SEQ ID NO: 301 - protein, 116 aa, Artificial Sequence
  Description of Artificial Sequence: Synthetic polypeptide
EVQLLEPGGGLVQPGGSLRLSCAASGFTFTEYEMIWVRQAPGKGLEWVSSISGNGANTYYADSVKGRFTISRDNSKNTLYLQMNSLRAEDTAVYYCAKEPLRFDNWGQGTLVTVSS

SEQ ID NO: 302 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYDLRYARFDYSGQGTLVTVSS

SEQ ID NO: 303 - protein, 123 aa, Artificial Sequence
  Description of Artificial Sequence: Synthetic polypeptide
EEQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYATRYARFDYWGQGTLVTVSS

SEQ ID NO: 304 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNFKNTLYLQMNSLRAEDTAVYYCAKEPITYDMRYARFDYGGQGTLVTVSS

SEQ ID NO: 305 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYDMRYARFDNWGQGTLVTVSN

SEQ ID NO: 306 - protein, 123 aa, Artificial Sequence
  Description of Artificial Sequence: Synthetic polypeptide
EVQLLESGGGLVQPGGSLRLSCTASGFTFNTYEMSWVRQAPGKGLEWVSGIGRRGFTTYYADSVKGRFTISRDNSKNTLYLQMNSLRAEDTAVYYCAKEPITYDLRYARFDYSGQGTLVTVSS

SEQ ID NO: 307 - protein, 123 aa, Artificial Sequence
  Description of Artificial Sequence: Synthetic polypeptide
EVQLMESGGGLVQPGGSLRLSCTASGFSFNMYEMSWVRQAPGKGLEWVSGISRRGYTTYYADSVKGRFTISRDNSKNTLYLQMNSLRAEDTAVYYCAKEPITYDMRYARFDYWGRGTLVTVSS

SEQ ID NO: 308 - protein, 123 aa, Artificial Sequence
  Description of Artificial Sequence: Synthetic polypeptide
EVQLLESGGGLVQPGGSLRLSCTASGFAFNMYEMSWVRQAPGKGLEWVSGISRHGFTTYYADSVKGRFTVSRDNSKNTLYLQMNSLRAEDTAVYYCAKEPITYDMRYARSDYWGQGTLVTVSS

SEQ ID NO: 309 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYFCAKEPITYDMRYARSDYWGQGTLVTVSS

SEQ ID NO: 310 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYSMRYARFDYSGLGTMVTVSS

SEQ ID NO: 311 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYDMRYARFDYSGQGTLVTVSS

SEQ ID NO: 312 - protein, 123 aa, Artificial Sequence
  Description of Artificial Sequence: Synthetic polypeptide
EVQLLESGGGLVQPGGSLRLSCTASGFTFNMYEMSWVRKAPGKGLEWVSGISRHGFTTYYADSVKGRFTISRDNSKNTLYLQMNSLRAEDTAVYYCAKEPITYDMRYARFDYWGQGTLVTVSS

SEQ ID NO: 313 - protein, 123 aa, Artificial Sequence
  Description of Artificial Sequence: Synthetic polypeptide
EVQLFESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYDMRYARFDYWGRGTLVTVSS

SEQ ID NO: 314 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYDMRYARFDYWGRGTLVTVSS

SEQ ID NO: 315 - protein, 123 aa, Artificial Sequence
  Description of Artificial Sequence: Synthetic polypeptide
EVQLLESGGGSVQPGGSLRLSCTASGFSFNMYEMSWVRQAPGKGLEWVSGISRRGFTTYYADSVKGRFTISRDNSKNTLYLQMNSLRAEDTAVYYCAKEPITYDMRYARFDYWGQGTLVTVSG

SEQ ID NO: 316 - protein, 123 aa, Artificial Sequence
  Description of Artificial Sequence: Synthetic polypeptide
EVQLLESGGGLVQPGGSLRLSCTASGFTFNMYEMSWVRKAPGKGLEWVSGISRRGFTTYYADSVKGRFTISRDNSKNTLYLQMNSLRAEDTAVYYCAKEPITYDMRYARFDYWGQGTLVTVSS

SEQ ID NO: 317 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFTFEDWGQGTLVTVSS

SEQ ID NO: 318 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFTFDDWGQGTLVTVSS

SEQ ID NO: 319 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCTKLPFIFEYWGQGTLVTVSS

SEQ ID NO: 320 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFMFDDRGQGTLVTVSS

SEQ ID NO: 321 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYYCAKLPFTFDDWGQGTLVTVSS

SEQ ID NO: 322 - protein, 116 aa, Artificial Sequence
  Description of Artificial Sequence: Synthetic polypeptide
EVQLLESGGGLVQPGGSLRLSCAASGFSFRDYEMWWYRQAPGKGLERVSAINPQGTRTYYADSVKGRFTISRDNSKNTLYLQMNSLRAEDTAVYYCAKLPFIFDNRGQGTLVTVSS

SEQ ID NO: 323 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTSVYHCAKPPFIFGDWGPGTLVTVSS

SEQ ID NO: 324 - protein, 116 aa, Artificial Sequence
  Description of Artificial Sequence: Synthetic polypeptide
EVQLLESGGGLVQPGGSRRLSCAASGFTFRDYEMWWVRQAPGKGLERVSAINPQGTRTYYADSVKGRFTISRDNSKNTLYLQMNSLRAEDTAVYYCAKLPFTFEDWGQGTLVTVSS

SEQ ID NO: 325 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYYCAKLPFMFDDRGQGTLVTVSS

SEQ ID NO: 326 - protein, 116 aa, Artificial Sequence
  Description of Artificial Sequence: Synthetic polypeptide
EVQLLESGGGLVQPGGSLRLSCAASGFTFRDYEMWWVRQAPGKVLERVSAINPQGTRTYYADSVKGRFTISRDNSKNMLYLQMNSLRAEDTAVYYCAKLPFMFDDRGQGTLVTVSS

SEQ ID NO: 327 - protein, 116 aa, Artificial Sequence; identical to SEQ ID NO: 320
  Description of Artificial Sequence: Synthetic polypeptide

SEQ ID NO: 328 - protein, 116 aa, Artificial Sequence
  Description of Artificial Sequence: Synthetic polypeptide
EVQLLESGGGLIQPGGSLRLSCAASGFTFRDYEMWWVRQAPGKGLERVSAINPQGTRTYYADSVKGRFTISRDNSKNTLYLQMNSLRAEDTAVYYCLKLPFIFDYWGQGTLVTVSS

SEQ ID NO: 329 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRADDTAVYHCTKLPFIFDYWGQGTLVTVSS

SEQ ID NO: 330 - protein, 116 aa, Artificial Sequence
  Description of Artificial Sequence: Synthetic polypeptide
EVQLLESGGGLVQPGGSLRLSCAASGFTFRDYEMWWVRQAPGMVLERVSAINPQGTRTYYADSVKGRFTISRDNSKNTLYLQMNSLRAEDTAVYYCAKLPFFFDSRGQGTLVTVSS

SEQ ID NO: 331 - protein, 116 aa, Artificial Sequence
  Description of Artificial Sequence: Synthetic polypeptide
EVQLLESGGGLVQPGGSLRLSCAASGFTFRDYEMWWVRRAPGKGLERVSAINPQGTRTYYADSVKGRFTISRDNSKNTLYLQMNSLRAEDTAVYYCAKLPFTFEDWGQGTLVTVSS

SEQ ID NO: 332 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYYCAKLPFTFEDWGQGTLVTVSS

SEQ ID NO: 333 - protein, 116 aa, Artificial Sequence
  Description of Artificial Sequence: Synthetic polypeptide
EVQLLESGGGLVQPGGSLRLSCAASGFSFRDYEMWWYRQAPGKGLERVSAINPQGTRTYYADSVKGRFTISRDNSKNTLYLQMNSLRAEDTAVYYCAKLPFTFEDWGQGTLVTVSS

SEQ ID NO: 334 - protein, 116 aa, Artificial Sequence
  Description of Artificial Sequence: Synthetic polypeptide
EVQLLESGGGLVQPGGSLRLSCAASGFTFRDYEMWWVRQAPGKVLERVSAINPQGTRTYYADSVKGRFTISRDNSKNMLYLQMNSLRAEDTAVYYCAKLPFTFEDWGQGTLVTVSS

SEQ ID NO: 335 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYHCAKLPFTFEDWGQGTLVTVSS

SEQ ID NO: 336 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCTKLPFTFEDWGQGTLVTVSS

SEQ ID NO: 337 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCLKLPFTFEDWGQGTLVTVSS

SEQ ID NO: 338 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRADDTAVYHCTKLPFIFEYWGQGTLVTVSS

SEQ ID NO: 339 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYYCAKEPYSFDSWGQGTLVTVSS

SEQ ID NO: 340 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYHCAKEPYSYDYWGQGTLVTVSS

SEQ ID NO: 341 - protein, 116 aa, Artificial Sequence
  Description of Artificial Sequence: Synthetic polypeptide
EVQLLESGGGLVQPGGSLRLSCAASGFTFRDYEMWWVRRAPGKGLERVSAINPQGTRTYYADSVMGRFTISRDNSKNTLYLQMNSLRAEDTAVYYCAKLPFTFDDWGQGTLVTVSS

SEQ ID NO: 342 - protein, 116 aa, Artificial Sequence
  Description of Artificial Sequence: Synthetic polypeptide
EVQLLESGGGLVQPGGSLRLSCAASGFTFRDYEMWWVRRAPGKGLERVSAINPQGTRTYYADSVMGRFTISRDNSKNTLYLQMNSLRAEDTAVYYCAKLPFMFDDRGQGTLVTVSS

SEQ ID NO: 343 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYYCAKLPFMFDDWGQGTLVTVSS

SEQ ID NO: 344 - protein, 116 aa, Artificial Sequence
  Description of Artificial Sequence: Synthetic polypeptide
EVQLLESGGGLVQPGGSLRLSCAASGFTFAGYELWWVRQAPGKGLERVSAINPQGTRTYYADSVMGRFTISRDNSKNTLYLQMNSLRAEDTAVYYCAKLPFTFDDWGQGTLVTVSS

SEQ ID NO: 345 - protein, 116 aa, Artificial Sequence
  Description of Artificial Sequence: Synthetic polypeptide
EVQLLESGGGLVQPGGSLRLSCAASGFTFAGYELWWVRQAPGKGLERVSAINPQGTRTYYADSVMGRFTISRDNSKNTLYLQMNSLRAEDTAVYYCAKLPFMFDDRGQGTLVTVSS

SEQ ID NO: 346 - protein, 116 aa, Artificial Sequence
  Description of Artificial Sequence: Synthetic polypeptide
EVQLLESGGGLVQPGGSLRLSCAASGFTFAGYEMWWFRQAPGKGLERVSAINPQGTRTYYADSVMGRFTISRDNSKNTLYLQMNSLRAEDTAVYYCAKLPFTFDDWGQGTLVTVSS

SEQ ID NO: 347 - protein, 116 aa, Artificial Sequence
  Description of Artificial Sequence: Synthetic polypeptide
EVQLLESGGGLVQPGGSLRLSCAASGFTFAGYEMWWFRQAPGKGLERVSAINPQGTRTYYADSVMGRFTISRDNSKNTLYLQMNSLRAEDTAVYYCAKLPFMFDDRGQGTLVTVSS

SEQ ID NO: 348 - protein, 116 aa, Artificial Sequence
  Description of Artificial Sequence: Synthetic polypeptide
EVQLLESGGGLVQPGGSLRLSCAASGFTFRDYEMWWVRQAPGKGLEWVSAINPQGTRTYYADSVMGRFTISRDNSKNTLYLQMNSLRAEDTAVYYCAKLPFTFDDWGQGTLVTVSS

SEQ ID NO: 349 - protein, 116 aa, Artificial Sequence
  Description of Artificial Sequence: Synthetic polypeptide
EVQLLESGGGLVQPGGSLRLSCAASGFTFRDYEMWWVRQAPGKGLEWVSAINPQGTRTYYADSVMGRFTISRDNSKNTLYLQMNSLRAEDTAVYYCAKLPFMFDDRGQGTLVTVSS

SEQ ID NO: 350 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPTYFSDRGQGTLVTVSS

SEQ ID NO: 351 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFFFEEWGQGTLVTVSS

SEQ ID NO: 352 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPTYFKDWGQGTLVTVSS

SEQ ID NO: 353 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFSEWGQGTLVTVSS

SEQ ID NO: 354 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYHCAKLPMFFEDWGQGTLVTVSN

SEQ ID NO: 355 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFPFSEWGQGTLVTVSS

SEQ ID NO: 356 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMDSLRAEDTAVYYCAKLPFYFSEWGQGTLVTVSS

SEQ ID NO: 357 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPYGNLTYYADSVKGRFTISRDNSKNTLYLQMNSLRAEDTAVYYCAKLPFTFEDWGQGTLVTVSS

SEQ ID NO: 358 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPPGTLTYYADSVKGRFTISRDNSKNTLYLQMNSLRAEDTAVYYCAKLPFTFEDRGQGTLVTVSS

SEQ ID NO: 359 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGLTYYADSVKGRFTISRDNSKNTLYLQMNSLRAEDTAVYYCAKLPFTFEDWGQGTLVTVSS

SEQ ID NO: 360 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPMGGFTYYADSVKGRFTISRDNSKNTLYLQMNSLRAEDTAVYYCAKLPFTFEDWGQGTLVTVSS

SEQ ID NO: 361 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSHTYYADSVKGRFTISRDNSKNTLYLQMNSLRAEDTAVYYCAKLPFTFEDWGQGTLVTVSS

SEQ ID NO: 362 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPSGGLTYYADSVKGRFTISRDNSKNTLYLQMNSLRAEDTAVYYCAKLPFTFDDRGQGTLVTVSS

SEQ ID NO: 363 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPHGSLTYYADSVKGRFTISRDNSKNTLYLQMNSLRAEDTAVYYCAKLPFTFDDWGQGTLVTVSS

SEQ ID NO: 364 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGRLTYYADSVKGRFTISRDNSKNTLYLQMNSLRAEDTAVYYCAKLPFTFEDWGQGTLVTVSS

SEQ ID NO: 365 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYYCAKLPFTFEDWGQGTLVTVSS

SEQ ID NO: 366 - protein, 116 aa, Artificial Sequence
  Description of Artificial Sequence: Synthetic polypeptide
EVQLLESGGGLVQPGGSLRLSCAASGFTFPDYEMWWVRQAPGKGLERVSAINPQGTRTYYADSVKGRFTISRDNSKNTLYLQMNSLRAEDTAVYHCAKLPFTFDDWGQGTLVTVSS

SEQ ID NO: 367 - protein, 116 aa, Artificial Sequence
  Description of Artificial Sequence: Synthetic polypeptide
EVQLLESGGGLVQPGGSLRLSCADSGFTFPPVEMWWVRQAPGKGLERVSAINPQGTRTYYADSVKGRFTISRDNSKNTLYLQMNSLRAEDTAVYYCAKLPFTFEDWGQGTLVTVSS

SEQ ID NO: 368 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPYGGLTYYADSVKGRFTISRDNSKNTLYLQMNSLRAEDTAVYYCAKLPFTFDDWGQGTLVTVSS

SEQ ID NO: 369 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGNHTYYADSVKGRFTISRDNSKNTLYLQMNSLRAEDTAVYYCAKLPFTFEDWGQGTLVTVSS

SEQ ID NO: 370 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPHGGYTYYADSVKGRFTISRDNSKNTLYLQMNSLRAEDTAVYYCAKLPFTFEDWGQGTLVTVSS

SEQ ID NO: 371 - protein, 116 aa, Artificial Sequence
  Description of Artificial Sequence: Synthetic polypeptide
EVQLLESGGGLVQPGGSLRLSCAASGFTFRDYEMWWVRQAPGRGLERVSAINPPGMLTYYADSVKGRFTISRDNSKNTLYLQMNSLRAEDTAVYYCAKLPFTFDDWGQGTLVTVSS

SEQ ID NO: 372 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGQLTYYADSVKGRFTISRDNSKNTLYLQMNSLRAEDTAVYYCAKLPFTFEDWGQGTLVTVSS

SEQ ID NO: 373 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGYTYYADSVKGRFTISRDNSKNTLYLQMNSLRAEDTAVYYCAKLPFTFDDWGQGTLVTVSS

SEQ ID NO: 374 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPSGGLTYYADSVKGRFTISRDNSKNTLYLQMNSLRAEDTAVYYCAKLPFTFEDWGQGTLVTVSS

SEQ ID NO: 375 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPSGGLTYYADSVKGRFTISRDNSKNTLYLQMNSLRAEDTAVYYCAKLPFTFDDWGQGTLVTVSS

SEQ ID NO: 376 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPSGTLTYYADSVKGRFTISRDNSKNTLYLQMNSLRAEDTAVYYCAKLPFTFEDWGQGTLVTVSS

SEQ ID NO: 377 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPYGSLTYYADSVKGRFTISRDNSKNTLYLQMNSLRAEDTAVYYCAKLPFTFDDWGQGTLVTVSS

SEQ ID NO: 378 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGYTYYADSVKGRFTISRDNSKNTLYLQMNSLRAEDTAVYYCAKLPFTFEDWGQGTLVTVSS

SEQ ID NO: 379 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGGLTYYADSVKGRFTISRDNSKNTLYLQMNSLRAEDTAVYYCAKLPFTFEDWGQGTLVTVSS

SEQ ID NO: 380 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSHTYYADSVKGRFTISRDNSKNTLYLQMNSLRAEDTAVYYCAKLPFTFDDWGQGTLVTVSS

SEQ ID NO: 381 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGTLTYYADSVKGRFTISRDNSRNTLYLQMNSLRAEDTAVYYCAKLPFTFDDWGQGTLVTVSS

SEQ ID NO: 382 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPNGRLTYYADSVKGRFTISRDNSKNTLYLQMNSLRAEDTAVYYCAKLPFTFADWGQGTLVTVSS

SEQ ID NO: 383 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGQLTYYADSVKGRFTISRDNSKNTLYLQMNSLRAEDTAVYYCAKLPFTFDDWGQGTLVTVSS

SEQ ID NO: 384 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPHGGLTYYADSVKGRFTISRDNSKNTLYLQMNSLRAEDTAVYYCAKLPFTFDDWGQGTLVTVSS

SEQ ID NO: 385 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGMLTYYADSVKGRFTISRDNSKNTLYLQMNSLRAEDTAVYYCAKLPFTFDDWGQGTLVTVSS

SEQ ID NO: 386 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPHGTLTYYADSVKGRFTISRDNSKNTLYLQMNSLRAEDTAVYYCAKLPFTFEDWGQGTLVTVSS

SEQ ID NO: 387 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYYCAKLPFTFDDWGQGTLVTVSS

SEQ ID NO: 388 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPYGGLTYYADSVKGRFTISRDNSKNTLYLQMNSLRAEDTAVYYCAKLPFTFEDWGQGTLVTVSS

SEQ ID NO: 389 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGFLTYYADSVKGRFTISRDNSKNTLYLQMNSLRAEDTAVYYCAKLPFTFEDWGQGTLVTVSS

SEQ ID NO: 390 - protein, 116 aa, Artificial Sequence
  Description of Artificial Sequence: Synthetic polypeptide
EVQLLESGGGLVRPGGSLRLSCAASGFTFRDYEMWWVRQAPGKGLERVSAINPYGGLTYYADSVKGRFTISRDNSKNTLYLQMNSLRAEDTAVYYCAKLPFTFEDWGQGTLVTVSS

SEQ ID NO: 391 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSKNTLYLQMNSLRAEDTAVYYCAKLPFTFEDWGQGTLVTVSS

SEQ ID NO: 392 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGLTYYADSVKGRFTISRDNSKNTLYLQMNSLRAEDTAVYYCAKLPFTFDDWGQGTLVTVSS

SEQ ID NO: 393 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPYGGLTYYADSVKGRFTISRDNSKNTLYLQMDSLRAEDTAVYYCAKLPFTFEDWGQGTLVTVSS

SEQ ID NO: 394 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGTLTYYADSVKGRFTISRDNSKNTLYLQMNSLRAEDTAVYYCAKLPFTFEDWGQGTLVTVSS

SEQ ID NO: 395 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGYTYYADSVKGRFTISRDNSKNTLYLQMNSLRAEDTAVYYCAKLPFTFEDWGRGTLVTVSS

SEQ ID NO: 396 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPYGNLTYYADSVKGRFTISRDNSKNTLYLQMNSLRAEDTAVYYCAKLPFTFDDWGQGTLVTVSS

SEQ ID NO: 397 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPHGGFTYYADSVKGRFTISRDNSKNTLYLQMNSLRAEDTAVYYCAKLPFTFEDWGQGTLVTVSS

SEQ ID NO: 398 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGFYTYYADSVKGRFTISRDNSKNTLYLQMNSLRAEDTAVYYCAKLPFTFDDWGQGTLVTVSS

SEQ ID NO: 399 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGGLTYYADSVKGRFTISRDNSKNTLYLQMNSLRAEDTAVYYCAKLPFTFDDWGQGTLVTVSS

SEQ ID NO: 400 - protein, 116 aa, Artificial Sequence
  Description of Artificial Sequence: Synthetic polypeptide
EVQLLESGGGLVQPGGSLRLSCAASGFAFRDYEMWWVRQAPGKGLERVSAINPHGSLTYYADSVKGRFTISRDNSKNTLYLQMNSLRAEDTAVYYCAKLPFTFEDWGQGTLVTVSS

SEQ ID NO: 401 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGGYTYYADSVKGRFTISRDNSKNTLYLQMNSLRAEDTAVYHCAKLPFTFEDWGQGTLVTVSS

SEQ ID NO: 402 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFWFTEWGQGTLVTVSS

SEQ ID NO: 403 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFMFSDRGQGTLVTVSS

SEQ ID NO: 404 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFLFQEWGQGTLVTVSS

SEQ ID NO: 405 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPTRFEDWGQGTLVTVSS

SEQ ID NO: 406 - protein, 116 aa, Artificial Sequence; identical to SEQ ID NO: 10
  Description of Artificial Sequence: Synthetic polypeptide

SEQ ID NO: 407 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCGKEPFRYDYWGQGTLVTVSS

SEQ ID NO: 408 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPTFFKDWGQGTLVTVSS

SEQ ID NO: 409 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFFFQEWGQGTLVTVSS

SEQ ID NO: 410 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPQLFHDRGQGTLVTVSS

SEQ ID NO: 411 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPQLFEDWGQGTLVTVSS

SEQ ID NO: 412 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYHCAKLPFGFSEWGQGTLVTVSS

SEQ ID NO: 413 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPQLFQDWGQGTLVTVSS

SEQ ID NO: 414 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFFFHEWGQGTLVTVSS

SEQ ID NO: 415 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPHYFKDWGQGTLVTVSS

SEQ ID NO: 416 - protein, 116 aa, Artificial Sequence
  Description of Artificial Sequence: Synthetic polypeptide
EVQLLESGGGLVQSGGSLRLSCAASGFTFRDYEMWWVRQAPGKGLERVSAINPQGTRTYYADSVKGRFTISRDNSKNTLYLQMNSLRAEDTAVYYCAKLPFYFEEWGQGTLVTVSS

SEQ ID NO: 417 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFRFSDRGQGTLVTVSS

SEQ ID NO: 418 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPTLFQDWGQGTLVTVSS

SEQ ID NO: 419 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFSEWGQGTLVTVSN

SEQ ID NO: 420 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFWFQEWGQGTLVTVSS

SEQ ID NO: 421 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYYCAKLPFYFQEWGQGTLVTVSS

SEQ ID NO: 422 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYHCAKLPMFFEDWGQGTLVTVSN

SEQ ID NO: 423 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYYCAKLPFYFHEWGQGTLVTVSS

SEQ ID NO: 424 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYYCAKLPFFFQEWGQGTLVTVSS

SEQ ID NO: 425 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYYCAKLPFFFHEWGQGTLVTVSS

SEQ ID NO: 426 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSKNTLYLQMNSLRAEDTAVYYCAKLPFYFQEWGQGTLVTVSS

SEQ ID NO: 427 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSKNTLYLQMNSLRAEDTAVYHCAKLPMFFEDWGQGTLVTVSN

SEQ ID NO: 428 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSKNTLYLQMNSLRAEDTAVYYCAKLPFYFHEWGQGTLVTVSS

SEQ ID NO: 429 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSKNTLYLQMNSLRAEDTAVYYCAKLPFFFQEWGQGTLVTVSS

SEQ ID NO: 430 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSKNTLYLQMNSLRAEDTAVYYCAKLPFFFHEWGQGTLVTVSS

SEQ ID NO: 431 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGLTYYADSVKGRFTISRDNSKNTLYLQMNSLRAEDTAVYYCAKLPFYFQEWGQGTLVTVSS

SEQ ID NO: 432 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGLTYYADSVKGRFTISRDNSKNTLYLQMNSLRAEDTAVYHCAKLPMFFEDWGQGTLVTVSN

SEQ ID NO: 433 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGLTYYADSVKGRFTISRDNSKNTLYLQMNSLRAEDTAVYYCAKLPFYFHEWGQGTLVTVSS

SEQ ID NO: 434 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGLTYYADSVKGRFTISRDNSKNTLYLQMNSLRAEDTAVYYCAKLPFFFQEWGQGTLVTVSS

SEQ ID NO: 435 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGLTYYADSVKGRFTISRDNSKNTLYLQMNSLRAEDTAVYYCAKLPFFFHEWGQGTLVTVSS

SEQ ID NO: 436 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYHCAKLPMFFEDWGQGTLVTVSS

SEQ ID NO: 437 - protein, 119 aa, Artificial Sequence
  Description of Artificial Sequence: Synthetic polypeptide
EVQLLETGGGLVQPGGSLRLSCAASGFTFSTYHMQWVRRAPGKGLEWVSMIDADGLGTYYADPVKGRFTISRDNSKNTLYLQMNSLRAKDTAVYYCARPGPQFGQFDYLGQGTLVTVSS

SEQ ID NO: 438 - protein, 119 aa, Artificial Sequence
  Description of Artificial Sequence: Synthetic polypeptide
EVQLFESGGGLVQTGGSLRLSCAASGFTFSTYHMQWVRQAPGKGLEWVSMIDADGLGKYYADPVKGRFTISRDNSKNTLYLQMNSLRAEDTAVYYCVKPGPQFGQYDYWGQGTLVTVSS

SEQ ID NO: 439 - protein, 121 aa, Artificial Sequence
  Description of Artificial Sequence: Synthetic polypeptide
EVQLLESGGGLVQPGGSLRLSCSASGFTFSGYDMQWVRQAPGKGLEWVSTISASGVYTYYADSVKGRFTISRDNSKNTLYLQMNSLRAEDTAVYYCAKYPNRFALNSFDYRGRGTLVTVSS

SEQ ID NO: 440 - protein, 121 aa, Artificial Sequence
  Description of Artificial Sequence: Synthetic polypeptide
EVQLLESGGGLVQPGGSLRLSCAASGFTFSGYDMQWVRQAPGRGLEWVSTISASGVYTYYTDSVKGRFTTSRDNSKNTLYLQMNSLRAEDTAVYYCTKYPNRFARNNFDYWGQGTLVTVSS

SEQ ID NO: 441 - protein, 108 aa, Artificial Sequence
  Description of Artificial Sequence: Synthetic polypeptide
DILMTQSPSSLSASVGDRVTITCRANSSILWALAWYQQKPGEAPKLLIESSSGLQSGVPSRFSGSGSGTDFTLTISSLQPEDFATYYCVQNAVWPGTFSQGTKVEIKR

SEQ ID NO: 442 - protein, 108 aa, Artificial Sequence
  Description of Artificial Sequence: Synthetic polypeptide
DIQMTQSPSSLSASVGDRVTITCRADSSILWALAWYQQKPGKAPKLLIESSSGLQSGVPSRFSGSGSGTDFTLTISSLQPEDFATYYCVQNAVWPGTFGQGTKVEIKR

SEQ ID NO: 443 - protein, 108 aa, Artificial Sequence
  Description of Artificial Sequence: Synthetic polypeptide
DIQMTVSPSSLSASVGDRVTITCRADSSILWALAWYQQKPGKAPKLLIESSSGLQSGVPSRFSGSGSGTDFTLTISSLQPEDFATYYCVQNAVWPGTFGQGTKVEIKR

SEQ ID NO: 444 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGSGTDFTLTISSLQPEDFATYYCVQNAVWPGTFDQGTKVEIKR

SEQ ID NO: 445 - protein, 108 aa, Artificial Sequence
  Description of Artificial Sequence: Synthetic polypeptide
DIQMTQSPSSLSASVGDRVTITCRANSSILWALAWYQQKPGKAPKLLIESSTGLQSGVPSRFSGSGSGTDFTLTISSLQPEDFATYYCVQNAVWPGTFGQGTKVEIKR

SEQ ID NO: 446 - protein, 108 aa, Artificial Sequence
  Description of Artificial Sequence: Synthetic polypeptide
DIQMTVSPSSLSASVGDRVTITCRANSSILWALAWYQQKPGKAPKLLIESSSGLQSGVPSRFSGSGSGTDFTLTISSLQPEDFATYYCVQNAVWPGTFGQGTKVEIKR

SEQ ID NO: 447 - protein, 108 aa, Artificial Sequence
  Description of Artificial Sequence: Synthetic polypeptide
DIQMTQSPSSLSASVGDRVTITCRADSSILWALAWYQQKPGKAPKLLIESSSGLQSGVPSRFSGSGSGTDFTLTISSLQPEDFATYYCVQNAVWPGTFDQGTKVEIKR

SEQ ID NO: 448 - protein, 108 aa, Artificial Sequence
  Description of Artificial Sequence: Synthetic polypeptide
DIQMTQSPSSLSASVGDRVTITCRANSSILWALAWYQQKPGKAPELLIESSSGLQSGVPSRFSGSGSGTDFTLTISSLQPEDFATYYCVQNAVWPGTFGQGTKVEIKR

SEQ ID NO: 449 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGSGTDFTLTISSLQPEDFATYYCVQNAVWPGTFGQGTKVENKR

SEQ ID NO: 450 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGSGTDFTLTISSLQPEDFATYYCVQNAVWPGTFGQGTKVEIKR

SEQ ID NO: 451 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGIPSRFSGSGSGTDFTLTISSLQPEDFATYYCVQNAVWPGTFGQGTKVEIKR

SEQ ID NO: 452 - protein, 108 aa, Artificial Sequence; identical to SEQ ID NO: 450
  Description of Artificial Sequence: Synthetic polypeptide

SEQ ID NO: 453 - protein, 108 aa, Artificial Sequence
  Description of Artificial Sequence: Synthetic polypeptide
DILLTQSPSSLSASVGDRVTITCRANSSILWALAWYQQKPGKAPKLLIESSSGLQSGVPSRFSGSGSGTDFTLTISSLQPEDFATYYCVQNAVWPGTFGQGTKVEIKR

SEQ ID NO: 454 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGTGTDFTLTISGLQPEDFATYYCVQNAVWPGTFDQGTKVEIKR

SEQ ID NO: 455 - protein, 108 aa, Artificial Sequence
  Description of Artificial Sequence: Synthetic polypeptide
DIQMTQSPSSLSASVGDRVTIPCRANSSILWALAWYQQKPGKAPKLLIESSSGLQSGVPSRFSGSASGTDFTLTISSLQPEDFATYYCVQNAVWPGTFGQGTKVEIKR

SEQ ID NO: 456 - protein, 108 aa, Artificial Sequence
  Description of Artificial Sequence: Synthetic polypeptide
DIQMAQSPSSLSASVGDRVTITCRASQTIERRLNWYQQKPGKAPKLLIYLASRLQSGVPSRFSGSGSGTDFTLTISSLQPEDFATYYCHQYASPPLTLGQGTKVEIKR

SEQ ID NO: 457 - protein, 108 aa, Artificial Sequence
  Description of Artificial Sequence: Synthetic polypeptide
DIQMTQSPSSLSASVGDSVTITCRASQTIERRLNWYQQKPGEAPKLLIYLASRLQSGVPSRFSGSGSGTDFTLTISSLQPEDFATYYCHQYASPPLTFGQGTNVEIKR

SEQ ID NO: 458 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTDFTLTISSLQPEDFAAYYCHQYESPPLTFGQGTKVEIKR

SEQ ID NO: 459 - protein, 108 aa, Artificial Sequence
  Description of Artificial Sequence: Synthetic polypeptide
DIQMTQSPSSLSASVGDRVTITCRASRTIERRLNWYQQKPGKAPKLLIYLASRLQSGVPSRFSGSGSGTDFTLTISSLQPEDFATYYCHQYESPPLTFGQGTKVEIKR

SEQ ID NO: 460 - protein, 108 aa, Artificial Sequence
  Description of Artificial Sequence: Synthetic polypeptide
DIQMTQSPSSLSASVGERVTITCRASQTIERRLNWYQQKPGKAPKLLIYLASRLQSGVPSRFSGSGSGTDFTLTISNLQPEDSATYYCHQYASPPLTLGQGTKVEIKR

SEQ ID NO: 461 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTDFTLTISSLQPEDFATYYCHQYASPPLTLGQGTKVEIKR

SEQ ID NO: 462 - protein, 108 aa, Artificial Sequence
  Description of Artificial Sequence: Synthetic polypeptide
DIQITQSPSSLSASVGDRVTITCRASQTIERRLNWYQQKPGKDPKLLIYLASRLQSGVPSRFSGSGSGTDFTLTISSLQPEDFATYYCHQYESPPLTFGQGTKVEIKR

SEQ ID NO: 463 - protein, 108 aa, Artificial Sequence
  Description of Artificial Sequence: Synthetic polypeptide
DIQMTQSPSSLSASVGDRVTITCRASQTIERRLNWYQQKPGEAPKLLIYLASRLQSGVPSRFSGSGSGTDFTLTISSLQPEDFATYYCHQYESPPLTFGQGTKVEIKW

SEQ ID NO: 464 - protein, 108 aa, Artificial Sequence
  Description of Artificial Sequence: Synthetic polypeptide
DIQLTQSPSSLSASVGDRVTITCRASQTIERRLNWYQQKPGKAPKLLIYLASRLQSGVPSRFSGSGSGTEFTLTISSLQPEDFATYYCHQYESPPLTFGQGTKVEIKR

SEQ ID NO: 465 - protein, 108 aa, Artificial Sequence
  Description of Artificial Sequence: Synthetic polypeptide
DIQMSQSPSTLSASVGDRVTITCRASQTIERRLNWYQQKPGKAPKLLIYLASRLQSGVPSRFSGSGSGTDFTLTISSLQPEDFATYYCHQYESPPLMFGQGTKVEIKR

SEQ ID NO: 466 - protein, 108 aa, Artificial Sequence
  Description of Artificial Sequence: Synthetic polypeptide
DIQMTQSPSSLSASVGDRVTITCRASQTIERRLNWYQQKPGKDPKLLIYLASRLQSGVPSRFSGSGSGTDFTLTISSLQPEDFATYYCHQYESPPLTFGQGTKVEIKR

SEQ ID NO: 467 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTDFTLTISSLQPEDFATYYCHQYESPPLTFGQGTKVEIKR

SEQ ID NO: 468 - protein, 108 aa, Artificial Sequence
  Description of Artificial Sequence: Synthetic polypeptide
DIQMTQSPSSLFASVGDRVTITCRASQTIERRLNWYQQKPGKAPKLLIYLASRLQSGVPSRFSGSGSGTDFTLTISSLQPEDFATYYCHQYESPPLTFGQGTKVEIKR

SEQ ID NO: 469 - protein, 108 aa, Artificial Sequence
  Description of Artificial Sequence: Synthetic polypeptide
DIQMTQYPSSLSASVGDRVTITCRASQSIERRLNWYQQKPGEAPKLLIYLASRLQSGVPSRFSGSGSGTDFTLTISSLQPEDFATYYCHQYESPPLTFGQGTKVEIKR

SEQ ID NO: 470 - protein, 108 aa, Artificial Sequence
  Description of Artificial Sequence: Synthetic polypeptide
DIQMTQSPSSLSASVGDRVTITCRASRTIERRLNWYQQKPGKAPKLLIYLASRLQSGVPSRFSGSGSGTDFTLTISSLQPEDFATYYCHPYESPPLTFGQGTKVEIKR

SEQ ID NO: 471 - protein, 108 aa, Artificial Sequence
  Description of Artificial Sequence: Synthetic polypeptide
DIQMTQSPSSLSASVGDRVTITCRASQAIERRLNWYQQKPGKAPKLLIYLASRLQSGVPSRFSGSGSGTDFTLTISSLQPEDFATYYCHQYASPPLTLGQGTKVEIKR

SEQ ID NO: 472 - protein, 108 aa, Artificial Sequence
  Description of Artificial Sequence: Synthetic polypeptide
NIQMTQSPSSLSASVGDRVTITCRASQAIERRLNWYQQKPGKAPKLLIYLASRLQSGVPSRFSGSGSGTDFTLTISSLQPEDFATYYCHQYESPPLTFGQGTKVEIKR

SEQ ID NO: 473 - protein, 108 aa, Artificial Sequence
  Description of Artificial Sequence: Synthetic polypeptide
DIQMTQSPSSLSASVGDRVTITCRASQTIGRRLNWYQQKPGKAPKLLIYLASRLQSGVPSRFSGSGSGSDFTLTISSLQPEDFATYYCHQYESPPLTFGQGTKVEIKR

SEQ ID NO: 474 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTEFTLTISSLQPEDFATYYCHQYESPPLTFGQGTKVEIKR

SEQ ID NO: 475 - protein, 108 aa, Artificial Sequence
  Description of Artificial Sequence: Synthetic polypeptide
DIQMTQTPSSLSASVGDRVTITCRASQTIERRLNWYQQKPGEAPKLLIYLASRLQSGVPSRFSGSGSGTDFTLTISSLQPEDFATYYCHQYESPPLTFGQGTKVKIKR

SEQ ID NO: 476 - protein, 108 aa, Artificial Sequence
  Description of Artificial Sequence: Synthetic polypeptide
DIQMTQSPSSLSASVGDSVTITCRASQTIERRLNWYQQKPGKAPKLLIYLASRLQSGVPSRFSGSGSGTDFTLTISSLQPEDFATYYCHQYESPPLTFGQGTKVEIKR

SEQ ID NO: 477 - protein, 108 aa, Artificial Sequence
  Description of Artificial Sequence: Synthetic polypeptide
HIQMTQSPSSLSASVGDRVTITCRASQTIERRLNWYQQKPGKAPKLLIYLASRLQSGVPSRFSGSGSGTDFTLTISSLQPEDFATYYCHQYESPPLTFGQGTKVEIKR

SEQ ID NO: 478 - protein, 108 aa, Artificial Sequence
  Description of Artificial Sequence: Synthetic polypeptide
DVQMTQSPSSLSASVGDRVTITCRASQTIERRLNWYQQKPGEAPKLLIYLTSRLQSGVPSRFSGSGSGTDFTLTISSLQPEDFATYYCHQYASPPLTFGQGTKVEIKR

SEQ ID NO: 479 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTDFTLTISSLQPEDFATYYCHQYESPPLTFGQGTKVVIKR

SEQ ID NO: 480 - protein, 108 aa, Artificial Sequence
  Description of Artificial Sequence: Synthetic polypeptide
DIQMTQSPSSLSASVGDRVTITCRASQTIERRLNWYQQKPGKAPRLLIYLATRLQSGVPSRFSGSGSGTDFTLTISSLQPEDFATYYCHQYESPPLTFGQGTKVEIKR

SEQ ID NO: 481 - protein, 108 aa, Artificial Sequence
  Description of Artificial Sequence: Synthetic polypeptide
DIQMTQSPSSLSASVGDRVTITCRASQPIERRLNWYQQKPGKAPKLLIYLASRLQSGVPSRFSGSGSGTDFTLTISSLQPEDFATYYCHQYESPPLTFGQGTKVEIKR

SEQ ID NO: 482 - protein, 108 aa, Artificial Sequence
  Description of Artificial Sequence: Synthetic polypeptide
DIQMTQSPSSLSASVGDRVTITCRASQTIGRRLNWYQQKPGKAPKLLIYLASRLQSGVPSRFSGSGSGTDFTLTISSLQPEDFATYYCHQYESPPLTFGQGTKVEIKR

SEQ ID NO: 483 - protein, 108 aa, Artificial Sequence
  Description of Artificial Sequence: Synthetic polypeptide
DIQMTQSPSSLSASVGDRVTITCRASQSIERRLNWYQQKPGKAPKLLIYLASRLQSGVPSRFSGSGSGTDFTLTISSLQPEDFATYYCHQYESPPLTFGQGTKVEIIR

SEQ ID NO: 484 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLATRLQSGVPSRFSGSGSGTDFTLTISSLQPEDFATYYCHQYESPPLTFGQGTKVEIKR

SEQ ID NO: 485 - protein, 108 aa, Artificial Sequence
  Description of Artificial Sequence: Synthetic polypeptide
DIQMTQSPSSLSASVGDRVTITCRASQSIERRLNWYQQKPGKAPKLLIYLASRLQSGVPSRFSGSGSGTDFTLTISSLQPEDFATYYCHQYESPPLTFGQGTKVEIKR

SEQ ID NO: 486 - protein, 108 aa, Artificial Sequence
  Description of Artificial Sequence: Synthetic polypeptide
DIQMTQSPSSLSASVGDRVTITCRASQTIERRLNWYQQKPGKAPRLLIYLATRLQSGVPSRFSGSGSGTDFTLTISSLQPEDFATYYCHQFEHPPLTFGQGTKVEIKR

SEQ ID NO: 487 - protein, 108 aa, Artificial Sequence
  Description of Artificial Sequence: Synthetic polypeptide
DIQMTQSPSSLSASVGDRVTITCRASFPIDRRLNWYQQKPGKAPRLLIYLATRLQSGVPSRFSGSGSGTDFTLTISSLQPEDFATYYCHQYESPPLTFGQGTKVEIKR

SEQ ID NO: 488 - protein, 108 aa, Artificial Sequence
  Description of Artificial Sequence: Synthetic polypeptide
DIQMTQSPSSLSASVGDRVTITCRASSTIGRRLNWYQQKPGKAPRLLIYLATRLQSGVPSRFSGSGSGTDFTLTISSLQPEDFATYYCHQYESPPLTFGQGTKVEIKR

SEQ ID NO: 489 - protein, 108 aa, Artificial Sequence
  Description of Artificial Sequence: Synthetic polypeptide
DIQMTQSPSSLSASVGDRVTITCRASSQIGRRLNWYQQKPGKAPRLLIYLATRLQSGVPSRFSGSGSGTDFTLTISSLQPEDFATYYCHQYESPPLTFGQGTKVEIKR

SEQ ID NO: 490 - protein, 108 aa, Artificial Sequence
  Description of Artificial Sequence: Synthetic polypeptide
DIQMTQSPSSLSASVGDRVTITCRASERIGRRLNWYQQKPGKAPRLLIYLATRLQSGVPSRFSGSGSGTDFTLTISSLQPEDFATYYCHQYESPPLTFGQGTKVEIKR

SEQ ID NO: 491 - protein, 108 aa, Artificial Sequence
  Description of Artificial Sequence: Synthetic polypeptide
DIQMTQSPSSLSASVGDRVTITCRASQQIGRRLNWYQQKPGKAPRLLIYLATRLQSGVPSRFSGSGSGTDFTLTISSLQPEDFATYYCHQYESPPLTFGQGTKVEIKR

SEQ ID NO: 492 - protein, 108 aa, Artificial Sequence
  Description of Artificial Sequence: Synthetic polypeptide
DIQMTQSPSSLSASVGDRVTITCRASQPIARRLNWYQQKPGKAPRLLIYLATRLQSGVPSRFSGSGSGTDFTLTISSLQPEDFATYYCHQYESPPLTFGQGTKVEIKR

SEQ ID NO: 493 - protein, 108 aa, Artificial Sequence
  Description of Artificial Sequence: Synthetic polypeptide
DIQMTQSPSSLSASVGDRVTITCRASGNIGRRLNWYQQKPGKAPRLLIYLATRLQSGVPSRFSGSGSGTDFTLTISSLQPEDFATYYCHQYESPPLTFGQGTKVEIKR

SEQ ID NO: 494 - protein, 108 aa, Artificial Sequence
  Description of Artificial Sequence: Synthetic polypeptide
DIQMTQSPSSLSASVGDRVTITCRASRNIDRRLNWYQQKPGKAPRLLIYLATRLQSGVPSRFSGSGSGTDFTLTISSLQPEDFATYYCHQYESPPLTFGQGTKVEIKR

SEQ ID NO: 495 - protein, 108 aa, Artificial Sequence
  Description of Artificial Sequence: Synthetic polypeptide
DIQMTQSPSSLSASVGDRVTITCRASQSIGRRLNWYQQKPGKAPRLLIYLATRLQSGVPSRFSGSGSGTDFTLTISSLQPEDFATYYCHQYESPPLTFGQGTKVEIKR

SEQ ID NO: 496 - protein, 108 aa, Artificial Sequence
  Description of Artificial Sequence: Synthetic polypeptide
DIQMTQSPSSLSASVGDRVTITCRASQNIGTRLNWYQQKPGKAPRLLIYLATRLQSGVPSRFSGSGSGTDFTLTISSLQPEDFATYYCHQYESPPLTFGQGTKVEIKR

SEQ ID NO: 497 - protein, 108 aa, Artificial Sequence
  Description of Artificial Sequence: Synthetic polypeptide
DIQMTQSPSSLSASVGDRVTITCRASEVIGRRLNWYQQKPGKAPRLLIYLATRLQSGVPSRFSGSGSGTDFTLTISSLQPEDFATYYCHQYESPPLTFGQGTKVEIKR

SEQ ID NO: 498 - protein, 108 aa, Artificial Sequence
  Description of Artificial Sequence: Synthetic polypeptide
DIQMTQSPSSLSASVGDRVTITCRASEAIGRRLNWYQQKPGKAPRLLIYLATRLQSGVPSRFSGSGSGTDFTLTISSLQPEDFATYYCHQYESPPLTFGQGTKVEIKR

SEQ ID NO: 499 - protein, 108 aa, Artificial Sequence
  Description of Artificial Sequence: Synthetic polypeptide
DIQMTQSPSSLSASVGDRVTITCRASTSIARRLNWYQQKPGKAPRLLIYLATRLQSGVPSRFSGSGSGTDFTLTISSLQPEDFATYYCHQYESPPLTFGQGTKVEIKR

SEQ ID NO: 500 - protein, 108 aa, Artificial Sequence
  Description of Artificial Sequence: Synthetic polypeptide
DIQMTQSPSSLSASVGDRVTITCRASLNIGRRLNWYQQKPGKAPRLLIYLATRLQSGVPSRFSGSGSGTDFTLTISSLQPEDFATYYCHQYESPPLTFGQGTKVEIKR

SEQ ID NO: 501 - protein, 108 aa, Artificial Sequence
  Description of Artificial Sequence: Synthetic polypeptide
DIQMTQSPSSLSASVGDRVTITCRASQTIERRLNWYQQKPGKAPRLLIYLSSKLQSGVPSRFSGSGSGTDFTLTISSLQPEDFATYYCHQYESPPLTFGQGTKVEIKR

SEQ ID NO: 502 - protein, 116 aa, Artificial Sequence
  Description of Artificial Sequence: Synthetic polypeptide
EVQLLESGGGLVQPGGSLRLSCAASGSTIAGYEMWWVRQAPGKGLERVSAISGSGGSTYYADSVKGRFTISRDDSKNTLYLQMNSLRAEDTAVYYCARDPYSFDYWGQGTLVTVSS

SEQ ID NO: 503 - protein, 116 aa, Artificial Sequence
  Description of Artificial Sequence: Synthetic polypeptide
EVQPLESGGGLVQPGGSLRLSCAASGFTFAGYEMWWVRQAPGKGLERISAISGSGGSTYYADSVKGRFTISRDDSKNTLYLQMNSLRAEDTAVYYCARDPYSFDYWGQGTLVTVSS

SEQ ID NO: 504 - protein, 116 aa, Artificial Sequence
  Description of Artificial Sequence: Synthetic polypeptide
EVQLLESGGGSVQPGGSLRLSCAATGSTFAGYEMWWVRQAPGKGLERVSAISGSGGSTYYADSVKGRFTISRDDSKNTLYLQMNSLRAEDTAVYYCARDPYSYDYWGQGTLVSVSS

SEQ ID NO: 505 - protein, 116 aa, Artificial Sequence
  Description of Artificial Sequence: Synthetic polypeptide
EVQLLESGGGLVQPGGSLRLSCAASGLTFAGYEMWWVRQAPGKGLERVSAISGSGGSTYYADSVKGRFTISRDDSKNTLYLQMNSLRAEDTAVYHCARDPYSFDYWGQGTLVTVSS

SEQ ID NO: 506 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYHCAKEPYSYDYWGQGTLVTVSS

SEQ ID NO: 507 - protein, 116 aa, Artificial Sequence
  Description of Artificial Sequence: Synthetic polypeptide
EVQLLESGGGLVQPGGSLRLSCAASGSTFAGYEMWWVRQAPGKGLERVSAISGSGGSTYYADSVKGRFTISRDDSKNTLYLQMNSLRPEDTAVYYCVKDPYSFDYWGQGTLVTVSS

SEQ ID NO: 508 - protein, 116 aa, Artificial Sequence
  Description of Artificial Sequence: Synthetic polypeptide
EVQLLESGGGLVQPGGSLRLSCAASGSTIAGYEMWWVRQAPGKGLERVSAISGSGGSTYYADSVKGRFTISRDDSKNTLYLQMNSLRAEDTAVYYCARDPYSFDYWGQGTPVTVSS

SEQ ID NO: 509 - protein, 116 aa, Artificial Sequence
  Description of Artificial Sequence: Synthetic polypeptide
EVQLMESGGGLVQPGGSLRLSCAASGSTFAGYEMWWYRQAPGKGLERVSAISGSGRSTYYADSVKGRFTISRDDSKNTLYLQMNSLRAEDTAVYYCAKDPYSFDYWGQGTLVTVSS

SEQ ID NO: 510 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAKEPYSFDYWGQGTLVTVSS

SEQ ID NO: 511 - protein, 116 aa, Artificial Sequence
  Description of Artificial Sequence: Synthetic polypeptide
EVQLLESGGGLVQPGGSLRLSCAASGSTIAGYEMWWVRQAPGKGLERVSAISGSGGSTYYADSVKGRFTISRDDSKNTLYLQMNSLRAEDTAVYYCAKDPYSFDYWGQGTLVTVSS

SEQ ID NO: 512 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCARDPYSFDYWGQGTLVSVSS

SEQ ID NO: 513 - protein, 116 aa, Artificial Sequence
  Description of Artificial Sequence: Synthetic polypeptide
EVQLLESGGGLVQPGGSLRLSCAASGFTIAGYEMWWVRQAPGKGLERVSAISGSGGSTYYADSVKGRFTISRDDSKNTLYLQMNSLRAEDTAVYYCAKDPYSFDYWGQGTLVTVSS

SEQ ID NO: 514 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTITRDDSKNTLYLQMNSLRAEDTAVYYCAKEPYSFDYWGQGTLVTVSS

SEQ ID NO: 515 - protein, 116 aa, Artificial Sequence
  Description of Artificial Sequence: Synthetic polypeptide
EVQLLESGGGLVQPGGSLRLSCAASGFTFAGYEMWWFRQAPGKGLERVSAISGSGGSTYYADSVKGRFTISRDDTKNTLYLQMNSLRAEDTAVYYCAKDPYSFDYWRQGTLVTVSS

SEQ ID NO: 516 - protein, 116 aa, Artificial Sequence
  Description of Artificial Sequence: Synthetic polypeptide
EVQLLESGGGLVQPGGSLRLSCAASGSTFAGYEVWWVRQAPGKGLERVSAISGSGGSTYYADSVKGRFTISRDDSKNTLYLQMNSLRAEDTAVYYCARDPYSFDYWGQGTLVTVSS

SEQ ID NO: 517 - protein, 116 aa, Artificial Sequence
  Description of Artificial Sequence: Synthetic polypeptide
EVQLLESGGGLVQPGGSLRLSCAASGSTFAGYEMWWVRQAPGKGLERISAISGSGGSTYYADSVKGRFTISRDDSKNTLYLKMNSLRAEDTAVYYCAKDPYSFDYWGQGTLVTVSS

SEQ ID NO: 518 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCARDPYSFDYWGQGTLVTVSS

SEQ ID NO: 519 - protein, 116 aa, Artificial Sequence
  Description of Artificial Sequence: Synthetic polypeptide
EVQLLESGGGLVQPGGSLRLSCAASGLTFAGYEMWWVRRAPGKGLERVAAISGSGGSTYYADSVKGRFTISRDDSKNTLYLQMNSLRAEDTAVYYCARDPYSFDYWGQGTLVTVSS

SEQ ID NO: 520 - protein, 116 aa, Artificial Sequence
  Description of Artificial Sequence: Synthetic polypeptide
EVQLLESGGGLVQPGGSLRLSCAASGFTFAGYELWWVRQAPGKGLERVSAISGSGGSTYYADSVKGRFTISRDDSKNTLYLQMNSLRAEDTAVYYCARDPYSFDYRGQGTLVTVSS

SEQ ID NO: 521 - protein, 116 aa, Artificial Sequence
  Description of Artificial Sequence: Synthetic polypeptide
EVQLLESGGGLVQPGGSLRLSCAAPGFTLAGYEMWWVRQAPGKGLERVSAISGSGGSTYYADSVKGRFTISRDDSKNTLYLQMNSLRAEDTAVYYCAKEPYSFDYWGQGTLVTVSS

SEQ ID NO: 522 - protein, 116 aa, Artificial Sequence
  Description of Artificial Sequence: Synthetic polypeptide
EVQLLESGGGLVQPGGSLRLSCAASGLTFAGYEMWWVRRAPGKGLERVSAISGSGGSTYYADSVKGRFTTSRDDSKNTLYLQMNSLRAEDTAVYYCARDPYSFDYWGRGTLVTVSS

SEQ ID NO: 523 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAKEPYSYDYWGHGTLVTVSS

SEQ ID NO: 524 - protein, 116 aa, Artificial Sequence
  Description of Artificial Sequence: Synthetic polypeptide
EVQPLESGGGLVQPGGSLRLSCAASGFTFAGYEMWWVRQAPGKGLERVSAISGSGGNTYYADSVKGRFTISRDDSKNTLYLQMNSLRAEDTGVYYCARDPYSFDYWGQGTLVTVSS

SEQ ID NO: 525 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAKEPYSFDSWGQGTLVTVSS

SEQ ID NO: 526 - protein, 116 aa, Artificial Sequence
  Description of Artificial Sequence: Synthetic polypeptide
EAQLLESGGGLVQPGGSLRLSCAASGLTFAGYEMWWVRQAPGKGLERVSAISGSGGSTYYADSVKGRFTISRDDSKNTLYLQMNSLRAEDTAVYYCARDPYSFDYWGQGTLVTVSS

SEQ ID NO: 527 - protein, 116 aa, Artificial Sequence
  Description of Artificial Sequence: Synthetic polypeptide
EVQLLESGGGLVQPGGSLRLSCAASGSTFAGYEMWWVRQAPGKGLERVSAISGSGGSTYYADSVKGRFSISRDDSKNTLYLQMNSLRAEDTAVYYCAKEPYSFDHWGQGTLVTVSS

SEQ ID NO: 528 - protein, 116 aa, Artificial Sequence
  Description of Artificial Sequence: Synthetic polypeptide
EVQLLESGGGLVQPGGSLRLSCAASGSTFAGYEMWWVRRAPGKGLERVSAISGSGGSTYYADSVKGRFTISRDDSKNTLYLQMNSLRAEDTAVYYCARDPYSFDYWGQGTLVTVSS

SEQ ID NO: 529 - protein, 116 aa, Artificial Sequence
  Description of Artificial Sequence: Synthetic polypeptide
EVQLLESGGGLVQPGGSLRLSCAASGFTFAGYEMWWFRQAPGKGLERVSAISGSGGSTYYADSVKGRFTISRDDSKNTLYLQMNSLRAEDTAVYYCAKDPYSFDNWGQGTLVTVSS

SEQ ID NO: 530 - protein, 116 aa, Artificial Sequence
  Description of Artificial Sequence: Synthetic polypeptide
EVQLLESGGGLVEPGGSLRLSCAASGFTFAGYEMWWVRQAPGKGLERVSAISGSGGSTYYADSVKGRFTISRDDSKNTLYLQMNSLRAEDTAVYYCAKEPYSFDHRGQGTLVTVSS

SEQ ID NO: 531 - protein, 116 aa, Artificial Sequence
  Description of Artificial Sequence: Synthetic polypeptide
EVQLLESGGGLVQPGGSLRLSCAASGYTFAGYEMWWVRQAPGKGLERVSAISGSGGSTYYADSVKGRFTISRDDSKNTLYLQMNSLRAEDTAVYYCAKEPYSFDHRGQGTLVTVSS

SEQ ID NO: 532 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDNSKNTLYLQMNSLRAEDTAVYHCAKEPYSYDYWGQGTLVTVSS

SEQ ID NO: 533 - protein, 116 aa, Artificial Sequence
  Description of Artificial Sequence: Synthetic polypeptide
EVQLLESGGGLVQPGGSLRLSCAASGFTFAGYEMWWFRQAPGKGLERVSAISGSGGSTYYADSVKGRFTISRDNSKNTLYLQMNSLRAEDTAVYYCAKDPYSFDNWGQGTLVTVSS

SEQ ID NO: 534 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAKEPYSYDYWGQGTLVTVSS

SEQ ID NO: 535 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAKDPYSFDNWGQGTLVTVSS

SEQ ID NO: 536 - protein, 116 aa, Artificial Sequence
  Description of Artificial Sequence: Synthetic polypeptide
EVQLLESGGGLVQPGGSLRLSCAASGFTFAGYEMWWVRQAPGKGLEWVSAISGSGGSTYYADSVKGRFTISRDDSKNTLYLQMNSLRAEDTAVYHCAKEPYSYDYWGQGTLVTVSS

SEQ ID NO: 537 - protein, 116 aa, Artificial Sequence
  Description of Artificial Sequence: Synthetic polypeptide
EVQLLESGGGLVQPGGSLRLSCAASGFTFAGYEMWWFRQAPGKGLEWVSAISGSGGSTYYADSVKGRFTISRDDSKNTLYLQMNSLRAEDTAVYYCAKDPYSFDNWGQGTLVTVSS

SEQ ID NO: 538 - protein, 116 aa, Artificial Sequence
  Description of Artificial Sequence: Synthetic polypeptide
EVQLLESGGGLVQPGGSLRLSCAASGFTFAGYELWWVRQAPGKGLERVSAISGSGGSTYYADSVKGRFTISRDDSKNTLYLQMNSLRAEDTAVYYCAKDPYSFDYRGQGTLVTVSS

SEQ ID NO: 539 - protein, 116 aa, Artificial Sequence
  Description of Artificial Sequence: Synthetic polypeptide
EVQLLESGGGLVQPGGSLRLSCAASGFTFAGYELWWVRQAPGKGLERVSAISGSGGSTYYADSVKGRFTISRDDSKNTLYLQMNSLRAEDTAVYYCARDPYSFDYWGQGTLVTVSS

SEQ ID NO: 540 - protein, 120 aa, Artificial Sequence
  Description of Artificial Sequence: Synthetic polypeptide
EVQLLESGGGLVQPGGSLRLSCAASGFTFPTAEMLWVRKAPGKGLEWVSSISASGGSTYYADSVKGRFTISRDNSKNTLYLQMNSLRAEDTAVYYCAKEPVSYVATFDYWGQGTLVTVSS

SEQ ID NO: 541 - protein, 120 aa, Artificial Sequence
  Description of Artificial Sequence: Synthetic polypeptide
EVQLLVSGGGLVQPGGSLRLSCAASGFTFPTAEMLWVRQAPGKGPEWVSSISASGGSTYYADSVKGRFTISRDNSKNTLYLQMNSLRAEDTAVYYCAKEPVSYVATFDYWGQGTLVTVSS

SEQ ID NO: 542 - protein, 120 aa, Artificial Sequence
  Description of Artificial Sequence: Synthetic polypeptide
EVQLLESGGGLVQPGGSLRLSCAASGFTFPTAEMVWVRKAPGMGLEWVSSISASGGYTYYADSVKGRFTISRDNSKNMLYLQMNSLRAEDTAVYYCAKEPVSYVATFDYWGQGALVTVTS

SEQ ID NO: 543 - protein, 120 aa, Artificial Sequence
  Description of Artificial Sequence: Synthetic polypeptide
EVQLLVSGGGLVQPGGSLRLSCAASGFTFPTAEMVWVRQAPGKGLEWVSSISASGGSTYYADSVKGRFSISRDDSKNTLYLQMNSLRAEDTAVYYCAKEPVSYVATFDYWGHGALVTVSS

SEQ ID NO: 544 - protein, 120 aa, Artificial Sequence
  Description of Artificial Sequence: Synthetic polypeptide
EVQLLESGGGLVQPGGSLRLSCAASGFTFPTAEMLWVRQAPGKGLEWVSSISASGGSTYYADSVKGRFTISRDNSKNTLYLQMNSLRAEDTAVYYCAKEPVSYVATFDYWGQGTLVTVSS

SEQ ID NO: 545 - protein, 120 aa, Artificial Sequence
  Description of Artificial Sequence: Synthetic polypeptide
EAQLLESGGGLVQPGGSLRLSCAASGFTFPTAEMVWVRQAPGKGLEWISSISASGGSTYYADSVKGRFTISRDNSKNTLYLQLNSLRAEDTAVYYCAKEPVSYVATFDYWGRGTLVTVSS

SEQ ID NO: 546 - protein, 120 aa, Artificial Sequence
  Description of Artificial Sequence: Synthetic polypeptide
EVQLLESGGGLVQPGGSLRLSCAASGFTFPTAEMLWVRQAPGKGLEWVSSISASGGSTYYADSVKGRFTISRDNSKSTLYLQMNSLRAEDTAVYYCAKEPVSYVATFDYWGPGALVTVSS

SEQ ID NO: 547 - protein, 120 aa, Artificial Sequence
  Description of Artificial Sequence: Synthetic polypeptide
EVQLLESGGGLVQPGGSLRLSCAASGFTFPTAEMLWVRKAPGKGLEWVSSISASGGSTYYADSVKGRFTISRDNSKNTLFLQMNSLRAEDTAVYYCAKEPVSYVATFDYWGQGTLVTVSS

SEQ ID NO: 548 - protein, 120 aa, Artificial Sequence
  Description of Artificial Sequence: Synthetic polypeptide
EVQLLESGGGLVQPGGSLRLSCAASGFTFPTAEMLWVRQAPGKGLEWVSSISASGGSTYYADSVKGRFTISRDNSKNTLYLQMNSLRAEDTAVYYCAKEPVSYVATFDYWGPGALVTVSS

SEQ ID NO: 549 - protein, 120 aa, Artificial Sequence
  Description of Artificial Sequence: Synthetic polypeptide
EVQLLESGGGLVQPGGSLRLSCAASGFTFPTAEMLWVRQAPGKGLEWVSSISASGGSTYYADSVKGRFTISRDNSKNTLYLQMNSLRAEDTAVYYCAKEPVYYVATFDYWGQGTLVTVSS

SEQ ID NO: 550 - protein, 120 aa, Artificial Sequence
  Description of Artificial Sequence: Synthetic polypeptide
EVQLLESGGGLVQPGGSLRLSCAASGFTFPTAEMLWVRKAPGKGLEWVSSISASGGSTYYADSVKGRFTISRDNSKNTLYLQMNSLRAEDAAVYYCAKEPVSYVATFDYWGQGTLVTVSS

SEQ ID NO: 551 - protein, 108 aa, Artificial Sequence
  Description of Artificial Sequence: Synthetic polypeptide
NIQMTQSPSSLSASVGDRVTITCRASHFIGTLLTWYQHKPGKAPKLLITYGSLLQSGVPSRFSGSGSGTDFTLTISSLQPEDFATYYCGQGVLWPATFGQGTKVEIKR

SEQ ID NO: 552 - protein, 108 aa, Artificial Sequence
  Description of Artificial Sequence: Synthetic polypeptide
DIQMTQSPSSLSASVGDRVTITCRASHFIGTLLSWYQQKPRKAPKLLITYGSLLQSGVPSRFSGSGSGTDFTLTISSLHPEDFATYYCGQGVLWPPTFGQGTKVEIKR

SEQ ID NO: 553 - protein, 108 aa, Artificial Sequence
  Description of Artificial Sequence: Synthetic polypeptide
DIQMTQSPSSLTASVGDRVTITCRASHFIGTLLSWYQQKPGKAPKLLVTYGSLLQSGVPSRFSGSGSGTDFTLTISNLQPEDFATYYCGQGVLWPPTFGQGTKVENIR

SEQ ID NO: 554 - protein, 108 aa, Artificial Sequence
  Description of Artificial Sequence: Synthetic polypeptide
DIQMTQSPSSLSASVGDRVTITCRASHFIATLLSWYQQKPGKAPKLLITYGSLLQSGVPSRFSGSGSGTDFTLTISSLQPEDFATYYCGQGVLWPPTFGQGTKVEIKR

SEQ ID NO: 555 - protein, 108 aa, Artificial Sequence
  Description of Artificial Sequence: Synthetic polypeptide
DIQMTQSPSFLSASVGDRVTITCRASHFIATLLSWYQQKPGKAPKLLITYGSLLQSGVPSRFSGSGSGTDFTLTISSLQPEDFATYYCGQGVLWPPTFGQGTKVEIKR

SEQ ID NO: 556 - protein, 108 aa, Artificial Sequence
  Description of Artificial Sequence: Synthetic polypeptide
DIQMTQSPSSLSASVGDRVTITCRASHFIGTLLSWYQQKPGKATKLLITYGSLLQSGVPSRFSGSGSGTDFTLTISSLQPEDFATYYCGQGVLWPPTFGQGTKVEIKR

SEQ ID NO: 557 - protein, 108 aa, Artificial Sequence
  Description of Artificial Sequence: Synthetic polypeptide
DIQMTQSPSSLSASVGDRVTITCRASHFIGSLLSWYQHKPGKAPKLLITYGSLLQSGVPSRFSGSGSGTDFTLTISSLQPEDFATYYCGQGVLWPATFGQGTKVEIKR

SEQ ID NO: 558 - protein, 108 aa, Artificial Sequence
  Description of Artificial Sequence: Synthetic polypeptide
DIQMTQSPSSLSASVGDRVTITCRASHFIGTLLSWYQHKPGKAPKLLITYGSLLQSGVPSRFSGSGSGTDFTLTISSLQPEDFATYYCGQGVLWPATFGQGTKVEIKR

SEQ ID NO: 559 - protein, 108 aa, Artificial Sequence
  Description of Artificial Sequence: Synthetic polypeptide
DIQMTQSPSSLSASVGDRVTITCRASHFIGTLLSWYQHKPGKAPKLLITYGSMLQSGVPSRFSGSGSGTDFTLTISSLQPEDFATYYCGQGVLWPATFGQGTKVEIKR

SEQ ID NO: 560 - protein, 108 aa, Artificial Sequence
  Description of Artificial Sequence: Synthetic polypeptide
DIQMTQSPSSLSASVGDRVTITCRASHFIGTLLSWYQHKPGKAPKLLITYGSLLQSGVPSRFSGSGSGTEFTLTISSLQPEDFATYYCGQGVLWPATFGQGTKVEIKR

SEQ ID NO: 561 - protein, 108 aa, Artificial Sequence
  Description of Artificial Sequence: Synthetic polypeptide
DIQMTQSPSSLTASVGDRVTITCRASHFIGTLLSWYQHKPGKAPKLLITYGSLLQSGVPSRFSGSGSGTEFTLTISSLQPEDFATYYCGQGVLWPATFGQGTKVEIKR

SEQ ID NO: 562 - protein, 108 aa, Artificial Sequence
  Description of Artificial Sequence: Synthetic polypeptide
NIQMTQSPSSLSASVGDRVTITCRASHFIGTLLSWYQHKPGKAPKLLITYGSLLQSGVPSRFSGSGSGTDFTLTISSLQPEDFATYYCGQGVLWPATFGQGTKVEIKR

SEQ ID NO: 563 - protein, 108 aa, Artificial Sequence
  Description of Artificial Sequence: Synthetic polypeptide
DIQMTQSPSSLSASVGDRVTINCRASHFIGTLLSWYQHKPGKAPKLLITYGSLLQSGVPSRFSGSGSGTDFTLTISSLQPEDFATYYCGQGVLWPATFGQGTKVEIKR

SEQ ID NO: 564 - protein, 108 aa, Artificial Sequence
  Description of Artificial Sequence: Synthetic polypeptide
DIQLTQSPSSLSASVGDRVTITCRASHFIGTLLSWYQQKPGKATKLLITYGSLLQSGVPSRFSGSGSGTDFTLTISSLQPEDFATYYCGQGVLWPPTFGQGTKVEIKR

SEQ ID NO: 565 - protein, 108 aa, Artificial Sequence
  Description of Artificial Sequence: Synthetic polypeptide
DIQMTQSPSSLYASVGDRVTITCRVSHFIGTLLSWYQQKPGKAPKLLITYGSLLQSGVPSRFSGSGSGTDFTLSISSLQPEDFATYYCGQGVLWPPTFGQGTKVEIKQ

SEQ ID NO: 566 - protein, 108 aa, Artificial Sequence
  Description of Artificial Sequence: Synthetic polypeptide
DIQMTQSPSSLSASVGDRVTITCRASHFIGTLLSWYQQKPRKAPKLLITYGSLLQSGVPSRFSGSGSGTDFTLTISSLQPEDFATYYCGQGVLWPPTFGQGTKVEIKR

SEQ ID NO: 567 - protein, 108 aa, Artificial Sequence
  Description of Artificial Sequence: Synthetic polypeptide
DIQIIQSPSSLSASVGDRVTITCRASHFIGTLLSWYQQKPGKAPKLLITYGSLLQSGVPSRFSGSGSGTDFTLTISSLQPEDFATYYCGQGVLWPPTFGQGTKVEIKR

SEQ ID NO: 568 - protein, 108 aa, Artificial Sequence
  Description of Artificial Sequence: Synthetic polypeptide
DIQMTQSPSSLSASVGDRVTITCRASHFIGTLLSWYQLKPGKAPKLLITYGSLLQSGVPSRFSGSGSGTDFTLTISSLQPEDFATYYCGQGVLWPATFGQGTKVEIKR

SEQ ID NO: 569 - protein, 108 aa, Artificial Sequence
  Description of Artificial Sequence: Synthetic polypeptide
DIQMTQSPSSLSASVGDRVTITCRASHFIGTLLSWYQLKPGKAPKLLITYGSWLQSGVPSRFSGSGSGTDFTLTISSLQPEDFATYYCGQGVLWPATFGQGTKVENKR

SEQ ID NO: 570 - protein, 108 aa, Artificial Sequence
  Description of Artificial Sequence: Synthetic polypeptide
DIQMTQSPSSLSASVGDRVTITCRASHFIGTLLSWYQLKPGKAPKLLITYGSLLQRGVPSRFSGSGSGTDFTLTISSLQPEDFATYYCGQGVLWPATFGQGTKVEIKR

SEQ ID NO: 571 - protein, 108 aa, Artificial Sequence
  Description of Artificial Sequence: Synthetic polypeptide
DIQMTQAPSSLSASVGDRVTITCRASHFIGTLLSWYQLKPGKAPKLLITYGSLLQSGVPSRFSGSGSGTDFTLTISSLQPEDFATYYCGQGVLWPATFGQGTKVENKR

SEQ ID NO: 572 - protein, 108 aa, Artificial Sequence
  Description of Artificial Sequence: Synthetic polypeptide
DIQMTQSPSSLSASVGDRVTITCRASHFIGSLLSWYQQKPGKAPKLLITYGSLLQSGVPSRFSGSGSGTDFALTISSLQPEDFATYYCGQGVLWPATFGQGTKVEIKR

SEQ ID NO: 573 - protein, 108 aa, Artificial Sequence
  Description of Artificial Sequence: Synthetic polypeptide
DIQMTQSPSSLSASVGDRVTITCRASHFIGSLLSWYQVKPGKAPKLLITYGSLLQSGVPSRFSGSGSGTDFTLTISSLQPEDFATYYCGQGVLWPATFGQGTTVEIKR

SEQ ID NO: 574 - protein, 108 aa, Artificial Sequence
  Description of Artificial Sequence: Synthetic polypeptide
DILMTQSPSSLSASVGDRVTITCRASHFIGSLLSWYQQKPGKAPKLLITYGSLLQSGVPSRFSGSGSGTDFTLTISSLQPEDFATYYCGQGVLWPATFGQGTKVEIKR

SEQ ID NO: 575 - protein, 108 aa, Artificial Sequence
  Description of Artificial Sequence: Synthetic polypeptide
DIQMTQSPSSLSASVGDRVTITCRASHFIGTLVSWYQQKPGKAPKLLITYGSLLQSGVPSRFSGSGSGTDFTLTISSLQPEDFATYYCGQGVLWPATYGQGTKVEIKR

SEQ ID NO: 576 - protein, 108 aa, Artificial Sequence
  Description of Artificial Sequence: Synthetic polypeptide
DIQMTQSPSSLSASVGDRVTITCRASHFIGTLVSWYQQKPGKAPKLLITYGSLLQSGVPSRFSGSGSGTDFTLTISSLQPEDFATYYCGQGVLWPATFGQGTKVENKR

SEQ ID NO: 577 - protein, 108 aa, Artificial Sequence
  Description of Artificial Sequence: Synthetic polypeptide
DIKMTQSPSSLSASVGDRVTITCRASHFIGTLVSWYQQKPGKAPKLLITYGSMLQSGVPSRFSGSGSGTDFTLTISSLQPEDFATYYCGQGVLWPATFGQGTKVEIKR

SEQ ID NO: 578 - protein, 108 aa, Artificial Sequence
  Description of Artificial Sequence: Synthetic polypeptide
DIQMTQSPSSLSASVGDRVTITCQASHFIGTLVSWYQQKPGKAPKLLITYGSLLQSGVPSRFSGSGSGTDFTLTISSLQPEDFATYYCGQGVLWPATFGQGTKVEIKR

SEQ ID NO: 579 - protein, 108 aa, Artificial Sequence
  Description of Artificial Sequence: Synthetic polypeptide
DIQMTQSPSSLSASVGDRVTITCRASHFIGTLLSWYQQKPGKAPKLLITYGSWLQSGVPSRFSGSGSGTDFTLTISSLQPEDFATYYCGQGVLWPATFGQGTKVEIKR

SEQ ID NO: 580 - protein, 108 aa, Artificial Sequence
  Description of Artificial Sequence: Synthetic polypeptide
DIQMTQSPSSLSASVGDRVTITCRASHFIGTLLSWYQLKPGKAPKLLITYGSWLQSGVPSRFSGSGSGTDFTLTISSLQPEDFATYYCGQGVLWPATFGQGTKVEIKR

SEQ ID NO: 581 - protein, 108 aa, Artificial Sequence
  Description of Artificial Sequence: Synthetic polypeptide
DIQMTQSPSSLSASVGDRVTITCRASHFIGTLLSWYQQKPGKAPKLLITYGSLLQSGVPSRFSGSGFGTDFTLTISSLQPEDFATYYCGQEVLWPATFGQGTKVEIKR

SEQ ID NO: 582 - protein, 108 aa, Artificial Sequence
  Description of Artificial Sequence: Synthetic polypeptide
DIQMTQSPSSLSASVGDRVSITCRASHFIGTLLSWYQQKPGKAPKLLITYGSLLQSGVPSRFSGSGFGTDFTLTISSLQPEDLATYYCGQEVLWPATFGQGTKVEIKR

SEQ ID NO: 583 - protein, 108 aa, Artificial Sequence
  Description of Artificial Sequence: Synthetic polypeptide
DIQMTQSPSSLSASVGDRVTITCQASHFIGTLLSWYQQKPGKAPKLLITYGSLLQSGVPSRFSGSGFGTDFTLTISSLQPEDFATYYCGQEVLWPATFGQGTKVEIKR

SEQ ID NO: 584 - protein, 108 aa, Artificial Sequence
  Description of Artificial Sequence: Synthetic polypeptide
DIQMTQSPSSLSASVGDRVTITCRASHFIGTLLSWYQQKPGKAPKLLITYGSLLQSGVPSRFSGSGFGTEFTLTIGSLQPEDFATYYCGQGVLWPATFGQGTKVEIKR

SEQ ID NO: 585 - protein, 108 aa, Artificial Sequence; identical to SEQ ID NO: 556
  Description of Artificial Sequence: Synthetic polypeptide

SEQ ID NO: 586 - protein, 108 aa, Artificial Sequence
  Description of Artificial Sequence: Synthetic polypeptide
DIQMTQSPSSLSASVGDRVTITCRASHFIASLLSWYQVKPGKAPKLLITYGSLLQSGVPSRFSGSGSGTDFTLTISSLQPEDFATYYCGQGVLWPATFGQGTTVEIKR

SEQ ID NO: 587 - protein, 108 aa, Artificial Sequence
  Description of Artificial Sequence: Synthetic polypeptide
DIQMTQSPSSLSASVGDRVTITCRASHFIAQLLSWYQVKPGKAPKLLITYGSLLQSGVPSRFSGSGSGTDFTLTISSLQPEDFATYYCGQGVLWPATFGQGTTVEIKR

SEQ ID NO: 588 - protein, 108 aa, Artificial Sequence
  Description of Artificial Sequence: Synthetic polypeptide
DIQMTQSPSSLSASVGDRVTITCRASHFIAQLLSWYQVKPGKAPKLLITYGSLLQSGVPSRFSGSGSGTDFTLTISSLQPEDFATYYCGQGVLWPATFGQGTTVEIRR

SEQ ID NO: 589 - protein, 108 aa, Artificial Sequence
  Description of Artificial Sequence: Synthetic polypeptide
DIQMTQSPSSLSASVGDRVTITCRASHYIASLLSWYQVKPGKAPKLLITYGSLLQSGAPSRFSGSGSGTDFTLTISSLQPEDFATYYCGQGVLWPATFGQGTTVEIKR

SEQ ID NO: 590 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWASYLQSGVPSRFSGSGSGTDFTLTISSLQPEDFATYYCGQGVLWPATFGQGTTVEIKR

SEQ ID NO: 591 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWTSYLQSGVPSRFSGSGSGTDFTLTISSLQPEDFATYYCGQGVLWPATFGQGTTVEIKR

SEQ ID NO: 592 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWSSYLQSGVPSRFSGSGSGTDFTLTISSLQPEDFATYYCGQGVLWPATFGQGTTVEIKR

SEQ ID NO: 593 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWGSWLQSGVPSRFSGSGSGTDFTLTISSLQPEDFATYYCGQGVLWPATFGQGTTVEIKR

SEQ ID NO: 594 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWASWLQSGVPSRFSGSGSGTDFTLTISSLQPEDFATYYCGQGVLWPATFGQGTTVEIKR

SEQ ID NO: 595 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWSSWLQSGVPSRFSGSGSGTDFTLTISSLQPEDFATYYCGQGVLWPATFGQGTTVEIKR

SEQ ID NO: 596 - protein, 108 aa, Artificial Sequence
  Description of Artificial Sequence: Synthetic polypeptide
DIQMTQSPSSLSASVGDRVTITCRASHWIAQLLSWYQVKPGKAPKLLITYGSLLQSGVPSRFSGSGSGTDFTLTISSLQPEDFATYYCGQGVLWPATFGQGTTVEIKR

SEQ ID NO: 597 - protein, 108 aa, Artificial Sequence
  Description of Artificial Sequence: Synthetic polypeptide
DIQMTQSPSSLSASVGDRVTITCRASHFIGSLLRWYQVKPGKAPKLLITYGSLLQSGVPSRFSGSGSGTDFTLTISSLQPEDFATYYCGQGVLWPATFGQGTTVEIKR

SEQ ID NO: 598 - protein, 108 aa, Artificial Sequence
  Description of Artificial Sequence: Synthetic polypeptide
DIQMTQSPSSLSASVGDRVTITCRASHRIAQLLSWYQVKPGKAPKLLITYGSLLQSGVPSRFSGSGSGTDFTLTISSLQPEDFATYYCGQGVLWPATFGQGTTVEIKR

SEQ ID NO: 599 - protein, 108 aa, Artificial Sequence
  Description of Artificial Sequence: Synthetic polypeptide
DIQMTQSPSSLSASVGDRVTITCRASHYIASLLSWYQVKPGKAPKLLITYGSLLQSGVPSRFSGSGSGTDFTLTISSLQPEDFATYYCGQGVLWPATFGQGTTVEIKR

SEQ ID NO: 600 - protein, 108 aa, Artificial Sequence
  Description of Artificial Sequence: Synthetic polypeptide
DIQMTQSPSSLSASVGDRVTITCRASHFIGSLLSWYQVKPGKAPKLLIRFGSLLQSGVPSRFSGSGSGTDFTLTISSLQPEDFATYYCGQGVLWPATFGQGTTVEIKR

SEQ ID NO: 601 - protein, 108 aa, Artificial Sequence
  Description of Artificial Sequence: Synthetic polypeptide
DIQMTQSPSSLSASVGDRVTITCRASHFIGSLLSWYQVKPGKAPKLLITYKSYLQSGVPSRFSGSGSGTDFTLTISSLQPEDFATYYCGQGVLWPATFGQGTTVEIKR

SEQ ID NO: 602 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWGSYLQSGVPSRFSGSGSGTDFTLTISSLQPEDFATYYCGQGVLWPATFGQGTTVEIKR

SEQ ID NO: 603 - protein, 108 aa, Artificial Sequence
  Description of Artificial Sequence: Synthetic polypeptide
DIQMTQSPSSLSASVGDRVTITCRASHFIWGPLSWYQVKPGKAPKLLITYGSLLQSGVPSRFSGSGSGTDFTLTISSLQPEDSATYYCGQGVLWPATFGQGTTVEIKR

SEQ ID NO: 604 - protein, 108 aa, Artificial Sequence
  Description of Artificial Sequence: Synthetic polypeptide
DIQMTQSPSSLSASVGDRVTITCRASHWIATLLSWYQVKPGKAPKLLITYGSLLQSGVPSRFSGSGSGTDFTLTISSLQPEDFATYYCGQGVLWPATFGQGTTVEIKR

SEQ ID NO: 605 - protein, 108 aa, Artificial Sequence
  Description of Artificial Sequence: Synthetic polypeptide
DIQMTQSPSSLSASVGDRVTITCRASHFIWGPLSWYQVKPGKAPKLLITYGSLLQSGVPSRFSGSGSGTDFTLTISSLQPEDFATYYCGQGVLWPATFGQGTTVEIKR

SEQ ID NO: 606 - protein, 108 aa, Artificial Sequence
  Description of Artificial Sequence: Synthetic polypeptide
DIQMTQSPSSLSASVGDRVTITCRASHFIGSLLNWYQVKPGKAPKLLITYGSLLQSGVPSRFSGSGSGTDFTLTISSLQPEDFATYYCGQGVLWPATFGQGTTVEIKR

SEQ ID NO: 607 - protein, 108 aa, Artificial Sequence
  Description of Artificial Sequence: Synthetic polypeptide
GIQMTQSPSSLSASVGDRVTITCRASHFIGSLLSWYQVKPGKAPKLLITYGSWLQSGVPSRFSGSGSGTDFTLTISSLQPEDFATYYCGQGVLWPATFGQGTTVEIKR

SEQ ID NO: 608 - DNA, 348 bp, Artificial Sequence
  Description of Artificial Sequence: Synthetic polynucleotide
gaggtgcagctgttggagtccgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcaggagtggggtcagggaaccctggtcaccgtctcgagc

SEQ ID NO: 609 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagc

SEQ ID NO: 610 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccaggctccagggaagggtctagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactactggggtcagggaaccctggtcaccgtctcgagc

SEQ ID NO: 611 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggaggaggagatgatttgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgcgaaagagccgtttcgttttgactactggggtcagggaaccctggtcaccgtctcgagc

SEQ ID NO: 612 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactgagtatgagatgatttgggtccgccaggctccagggaagggtctggagtgggtctcatctatttcgggtaatggtgctaatacatactacgcagactccgtgaagggccggttcaccatctcccgcgacaattccaagaacacgctgtatctgcaaatgaacagcctgcgtgccgaggacaccgcggtatattactgtgcgaaagagccgcttaggtttgactactggggtcagggaaccctggtcaccgtctcgagc

SEQ ID NO: 613 - DNA, 369 bp, Artificial Sequence
  Description of Artificial Sequence: Synthetic polynucleotide
gaggtgcagctgttggagtctgggggaggcttggtacagcctggggggtccctgcgtctctcctgtacagcctccggattcacctttaatatgtatgagatgtcgtgggtccgccaggctccagggaagggtctagagtgggtctcaggtattagtaggcgtggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgctatgaggtatgcgcgttttgactactggggtcagggaaccctggtcaccgtctcgagc

SEQ ID NO: 614 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtgcgaaacttccgtttatttttgactactggggtcagggaaccctggtcaccgtctcgagc

SEQ ID NO: 615 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgacttatcatatgcagtgggtccgccaggctccagggaagggtctggagtgggtctcaatgattgatgcggatggtcttgggacatactacgcagactccgtgaagggccggttcaccatctcccgcgacaattccaagaacacgctgtatctgcaaatgaacagcctgcgtgccgaggacaccgcggtatattactgtgcgaaaccgggtccgcagtttggtcagtttgactactggggtcagggaaccctggtcaccgtctcgagc

SEQ ID NO: 616 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcttccggattcaccttttcggggtatgatatgcagtgggtccgccaggctccagggaagggtctagagtgggtctcaacgattagtgcgtcgggtgtttttacatactacgcagactccgtgaagggccggttcaccacctcccgcgacaattccaagaacacgctgtatctgcaaatgaacagcctgcgtgccgaggacaccgcggtatattactgtgcgaaatatcctaatcgttttgcgcttaataattttgactactggggtcagggaaccctggtcaccgtctcgagc

SEQ ID NO: 617 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaaatagttctattttgtgggcgttagcttggtaccagcagaaaccagggaaagcccctaagctcctgatcgagagttcttccggtttgcaaagtggggtcccatcacgtttcagtggcagtggatctgggacagatttcactctcaccatcagcagtctgcaacctgaagattttgctacgtactactgtgttcagaatgcgggttggcctggtacgttcggccaagggaccaaggtggaaatcaaacgg

SEQ ID NO: 618 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgcgagtccacctttgacgttcggccaagggaccaaagtggaaatcaaacgg

SEQ ID NO: 619 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgaaagatccttatagttttgactactggggtcagggaaccctggtcaccgtctcgagc

SEQ ID NO: 620 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgactgctgagatggtgtgggtccgccaggctccagggaagggtctagagtgggtctcatctatttcggctagtggtggttctacatactacgcagactccgtgaagggccggttcaccatctcccgcgacaattccaagaacacgctgtatctgcaaatgaacagcctgcgtgccgaggacaccgcggtatattactgtgcgaaagagccggtgagttatgtggcgacgtttgactactggggtcagggaaccctggtcaccgtctcgagc

SEQ ID NO: 621 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagcagaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 622 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgaagaatgagatgacgtgggtccgccaggctccagggaagggtctagagtgggtctcagcgattgagtcggatggtcaggctacatactacgcagactccgtgaagggccggttcaccatctcccgcgacaattccaagaacacgctgtatctgcaaatgaacagcctgcgtgctgaggacaccgcggtatattactgtgcgaaaaatcggattcctgatcttgtgtttgactactggggtcagggaaccctggtcaccgtctcgagc

SEQ ID NO: 623 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgctggggctatgacgtgggtccgccaggctccagggaagggtctagagtgggtctcatctattgataaggagggtctgtctacatactacgcagactccgtgaagggccggttcaccatctcccgcgacaattccaagaacacgctgtatctgcaaatgaacagcctgcgtgccgaggataccgcggtatattactgtgcgaaaggtaggattcctgggctggtttttgactactggggtcagggaaccctggtcaccgtctcgagc

SEQ ID NO: 624 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgatgcggcgatgacttgggtccgccaggctccagggaagggtctagagtgggtctcagcgattcagcctatgggtgatggtacatactacgcagactccgtgaagggccggttcaccgtctcccgcgacaattccaagaacacgctgtatctgcaaatgaacagcctgcgtgccgaggacaccgcggtatattactgtgcgaaagggcgtattcctactcttcagtttgactactggggtcagggaaccctggtcaccgtctcgagc

SEQ ID NO: 625 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattcgcctatgacttgggtccgccaggctccagggaagggtctagagtgggtctcagctattacttcgaatggttatgagacatactacgcagactccgtgaagggccggttcaccatctcccgcgacaattccaagaacacgctgtatctgcaaatgaacagcctgcgtgccgaggacaccgcggtatattactgtgcgaaagggcgtattcctactcttcattttgactactggggtcagggaaccctggtcaccgtctcgagc

SEQ ID NO: 626 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgagcatgatatgagttgggtccgccaggctccagggaagggtctagagtgggtctcacgtattggtccggatggttttcatacatactacgcagactccgtgaagggccggttcaccatctcccgcgacaattccaagaacacgctgtatctgcaaatgaacagcctgcgtgccgaggacaccgcggtatattactgtgcgaaagggcgtattcctactcttcattttgactactggggtcagggaaccctggtcaccgtctcgagc

SEQ ID NO: 627 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgagtatcatatgtcttgggtccgccaggctccagggaagggtctagagtgggtctcaaggattactcctcttggtacgcttacatactacgcagactccgtgaagggccggttcaccatctcccgcgacaattccaagaacacgctgtatctgcaaatgaacagcctgcgtgccgaggacaccgcggtatattactgtgcgaaagggcgtattccttcgcttacgtttgactactggggtcagggaaccctggtcaccgtctcgagc

SEQ ID NO: 628 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtacgaatgcgatgagttgggtccgccaggctccagggaagggtctggagtgggtctcaaggatttcgccgggtggtgattatacatactacgcagactccgtgaagggccggttcaccatctcccgcgacaattccaagaacacgctgtatctgcaaatgaacagcctgcgtgccgaggataccgcggtgtattactgtgcgaaagggcgtgttccggatctgctttttgactactggggtcagggaaccctggtcaccgtctcgagc

SEQ ID NO: 629 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgtctgaggagatgtcttgggtccgccaggctccagggaagggtctagagtgggtctcaaggatttcggctgatggtgctaatacatactacgcagactccgtgaagggccggttcaccatctcccgcgacaattccaagaacacgctgtatctgcaaatgaacagcctgcgtgccgaggacgccgcggtatattactgtgcgaaagggcgtgttccggatctgctttttgactactggggtcagggaaccctggtcaccgtctcgagc

SEQ ID NO: 630 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgaggatgatatgacttgggtccgccaggctccagggaagggtctagagtgggtctcacgtattgcggttgatggtgatcggacatactacgcagactccgtgaagggccggttcaccatctcccgcgacaattccaagaacacgctgtatctgcaaatgaacagcctgcgtgccgaggacaccgcggtatattactgtgcgaaaggtaaggttccgtctcttcattttgactactggggtcagggaaccctggtcaccgtctcgagc

SEQ ID NO: 631 - DNA, 357 bp, Artificial Sequence
  Description of Artificial Sequence: Synthetic polynucleotide
gaggtgcagctgttggagtctgggggaggcttggtacagcctgggggatccctgcgtctctcctgtgcagcctccggattcacctttaggacgatggatatgtcttgggtccgccaggctccagggaagggtctagagtgggtctcacgtattacgggtgatggtatgaatacatactacgcagactccgtgaagggccggttcaccatctcccgcgacaattccaagaacacgctgtatctgcaaatgaacagcctgcgtgccggggacaccgcggtatattactgtgcgaaaggggtgactccggatttgacttttgactactggggtcagggaaccctggtcaccgtctcgagc

SEQ ID NO: 632 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcgtgatgatatgacgtgggtccgccaggctccagggaagggtctagagtgggtctcacgtattaatgctgggggtgtgcatacatactacgcagactccgtgaagggccggttcaccatctcccgcgacaattccaagaacacgctgtatctgcaaatgaacagcctgcgtgccgaggataccgcggtatattactgtgcgaaaggggtgactccggatttgacttttgactactggggtcagggaaccctggtcaccgtctcgagc

SEQ ID NO: 633 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgatgattctatgacgtgggtccgccaggctccagggaagggtctagagtgggtctcacggatttcgagtgatggtgcgagtacatactacgcagactccgtgaagggccggttcaccatctcccgcgacaattccaagaacacgctgtatctgcaaatgaacagcctgcgtgccgaggacaccgcggtatattactgtgcgaaaggggtgactccggatttgacttttgactactggggtcagggaaccctggtcaccgtctcgagc

SEQ ID NO: 634 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactgaggaggatatgacgtgggtccgccaggctccagggaagggtctagagtgggtctcacgtattgatagtgttggtgaggggacatactacgcagactccgtgaagggccggttcaccatctcccgcgacaattccaagaacacgctgtatctgcaaatgaacagcctgcgtgccgaggacaccgcggtatattactgtgcgaaaggggtgactccggatttgacttttgactactggggtcagggaaccctggtcaccgtctcgagc

SEQ ID NO: 635 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgattcggcgatgagttgggtccgccaggctccagggaagggtctagagtgggtctcacggattgataatcctggtcagcatacatactacgcagactccgtgaagggccggttcaccatctcccgcgacaattccaagaacacgctgtatctgcaaatgaacagcctgcgtgccgaggataccgcggtatattactgtgcgaaaggtactgttcctacgctggagtttgactactggggtcagggaaccctggtcaccgtctcgagc

SEQ ID NO: 636 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcagcatagtatgacttgggtccgccaggctccagggaagggtctagagtgggtctcacgtattgatggtgggggttataatacatactacgcagactccgtgaagggccggttcaccatctcccgcgacaattccaagaacacgctgtatctgcaaatgaacagcctgcgtgccgaggacaccgcggtatattactgtgcgaaaggggaggttcctcgtcttcattttgactactggggtcagggaaccctggtcaccgtctcgagc

SEQ ID NO: 637 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtcaggagcctatgacttgggtccgccaggctccagggaagggtctagagtgggtctcacggattgcgtataatggtggtgatacatactacgcagactccgtgaagggccggttcaccatctcccgcgacaattccaagaacacgctgtatctgcaaatgaacagcctgcgtgccgaggacaccgcggtatattactgtgcgaaagggattactcctaatttgacttttgactactggggtcagggaaccctggtcaccgtctcgagc

SEQ ID NO: 638 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaattatccgatgtcttgggtccgccaggctccagggaagggtctagagtgggtctcacgtattaatgctacgggttctattacatactacgcagactccgtgaagggccggttcaccatctcccgcgacaattccaagaacacgctgtatctgcaaatgaacagcctgcgtgccgaggacaccgcggtatattactgtgcgaaaggggttattcctcatttgatgtttgactactggggtcagggaaccctggtcaccgtctcgagc

SEQ ID NO: 639 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgtgattatgatatgagttgggtccgccaggctccagggaagggtctagagtgggtctcacgtattactggtactggtaatagtacatactacgcagactccgtgaagggccggttcaccatctcccgcgacaattccaagaacacgctgtatctgcaaatgaacagcctgcgtgccgaggacaccgcggtatattactgtgcgcaaggggtggtgccgtatcttgcttttgactactggggtcagggaaccctggtcaccgtctcgagc

SEQ ID NO: 640 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggctgatgcgatgacgtgggtccgccaggctccagggaagggtctagagtgggtctcaaggattaatgtggatggtgatcggacatactacgcagactccgtgaagggccggttcaccatctcccgcgacaattccaagaacacgctgtatctgcaaatgaacagcctgcgtgccgaggacaccgcggtatattactgtgcgaaaggtactgttcctacgctggagtttgactactggggtcagggaaccctggtcaccgtctcgagc

SEQ ID NO: 641 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatcgggcggatatgacgtgggtccgccaggctccagggaagggtctagagtgggtctcaaggatttcgggggagggtaagtgtacatactacgcagactccgtgaagggccggttcaccatctcccgcgacaattccaagaacacgctgtatctgcaaatgaacagcctgcgtgccgaggacaccgcggtatattactgtgcgaaagggatggttcctaatttggtttttgactactggggtcagggaaccctggtcaccgtctcgagc

SEQ ID NO: 642 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcattgggagccgatgtcttgggtccgccaggctccggggaagggtctagagtgggtctcacgtattaattcttctggttgggatacatactacgcagactccgtgaagggccggttcaccatctcccgcgacaattccaagaacacgctgtatctgcaaatgaacagcctgcgtgccgaggacaccgcggtatattactgtgcgaaagggatggttcctaatttggtttttgactactggggtcagggaaccctggtcaccgtctcgagc

SEQ ID NO: 643 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgatgagccgatgacttgggtccgccaggctccagggaagggtctagagtgggtctcacgtattcctcctgagggtgctccgacatactacgcagactccgtgaagggccggttcaccatctcccgcgacaattccaagaacacgctgtatctgcaaatgaacagcctgcgtgccgaggacaccgcggtatattactgtgcgaaagggattactcctaatttgacttttgactactggggtcagggaaccctggtcaccgtctcgagc

SEQ ID NO: 644 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcataatcatgatatgtcttgggtccgccaggctccagggaagggtctagagtgggtctcacgtattagtcggggtggtcttcagacatactacgcagactccgtgaagggccggttcaccatctcccgcgacaattccaagaacacgctgtatctgcaaatgaacagcctgcgtgccgaggacaccgcggtatattactgtgcgaaagggattgtgccggatctgcattttgactactggggtcagggaaccctggtcaccgtctcgagc

SEQ ID NO: 645 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatgagtatcctatgtcgtgggtccgccaggctccagggaagggtctagagtgggtctcacgtattaatggggatggtgctaatacatactacgcagactccgtgaagggccggttcaccatctcccgcgacaattccaagaacacgctgtatctgcaaatgaacagcctgcgtgccgaggacaccgcggtatattactgtgcgaaagggattattccggctatgcagtttgactactggggtcagggaaccctggtcaccgtctcgagc

SEQ ID NO: 646 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggatgtgcctatgtcgtgggtccgccaggctccagggaagggtctagagtgggtctcaaggattgatccttatggttctaatacatactacgcagactccgtgaagggccggttcaccatctcccgcgacaattccaagaacacgctgtatctgcaaatgaacagcctgcgtgccgaggacaccgcggtatattactgtgcgaaaggtattatgcctagtcttacttttgactactggggtcagggaaccctggtcaccgtctcgagc

SEQ ID NO: 647 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcggattatgatatgtcttgggtccgccaggctccagggaagggtctagagtgggtctcacgtatttcggcgcttggtgctactacatactacgcagactccgtgaagggccggttcaccatctcccgcgacaattccaagaacacgctgtatctgcaaatgaacagcctgcgtgccgaggacaccgcggtatattactgtgcgaaaggtcagcttccggcgttggagtttgactactggggtcagggaaccctggtcaccgtctcgagc

SEQ ID NO: 648 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagcgttattatatgacttgggtccgccaggctccagggaaggatctagagtgggtctcaggtattgttccttctggtaataggacatactacgcagactccgtgaagggccggttcaccatctcccgcgacaattccaagaacacgctgtatctgcaaatgaacagcctgcgtgccgaggacaccgcggtatattactgtgcgaaaggtaggattccggatctgcattttgactactggggtcagggaaccctggtcaccgtctcgagc

SEQ ID NO: 649 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgattatgatatgacttgggtccgccaggctccagggaagggtctagagtgggtctcaaggatttctccgacgggtgggcagacatactacgcagactccgtgaagggccggttcaccatctcccgcgacaattccaagaacacgctgtatctgcaaatgaacagcctgcgtgccgaggacaccgcggtatattactgtgcgaaaggtgttattccgtatttgtctttttctccgtttgactactggggtcagggaaccctggtcaccgtctcgagc

SEQ ID NO: 650 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctaagtattggatgggttgggcccgccaggctccagggaagggtctagagtgggtctcatcgattgattcgcatggtgctggtacatactacgcagactccgtgaagggccggttcaccatctcccgcgacaattccaagaacacgctgtatctgcaaatgaacagcctgcgtgtcgaggacaccgcggtatattactgtgcgaaaggtgctcctaagtttatgactacgtatacgtttgactactggggtcagggaaccctggtcaccgtctcgagc

SEQ ID NO: 651 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttttgtcttatccgatgcattgggtccgccaggctccagggaagggtctagagtgggtctcatcgattgattcgaggggttcggttacatactacgcagactccgtgaagggccggttcaccatctcccgcgacaattccaagaacacgctgtatctgcaaatgaacagcctgcgtgccgaggacaccgcggtatattactgtgcgaaaggtcatagttggacgtttgactactggggtcagggaaccctggtcaccgtctcgagc

SEQ ID NO: 652 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgaatagtaatatgacttgggtccgccaggctccagggaagggtctagagtgggtctcacgtattaatccggatggtgggtctacatactacgcagactccgtgaagggccggttcaccatctcccgcgacaattccaagaacacgctgtatctgcaaatgaacagcctgcgtgccgaggacaccgcggtatattactgtgcggaagggcgtattcctactcttcattttgactactggggtcagggaaccctggtcaccgtctcgagc

SEQ ID NO: 653 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggccgaggaggatgggttgggtccgccaggctccagggaagggtctagagtgggtctcatcgattgatgatattggtcgtaggacatactacgcagactccgtgaagggccggttcaccatctcccgcgacaattccaagaacacgctgtatctgcaaatgaacagcctgcgtgccgaggacaccgcggtatattactgtgcggaaggggcgcagggtgtgttgttgtttgactactggggtcagggaaccctggtcaccgtctcgagc

SEQ ID NO: 654 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattataggatggtttgggtccgccaggctccagggaagggtctagagtgggtctcatcgatttctacttctggtgagctgacatactacgcagactccgtgaagggccggttcaccatctcccgcgacaattccaagaacacgctgtatctgcaaatgaacagcctgcgtgccgaggacaccgcggtatattactgtgcggaaacggcgggtcagttttttgactactggggtcagggaaccctggtcaccgtctcgagc

SEQ ID NO: 655 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccggagtatgagatggtttgggtccgccaggctccagggaagggtctggagtgggtctcagcgatttcgcgtgagggtcgggctacatactacgcagactccgtgaagggccggttcaccatctcccgcgacaattccaagaacacgctgtatctgcaaatgaacaacctgcgtgccgaggataccgcggtatattactgtgcgaaagagcctgttcgttttgactactggggtcagggaaccctggtcaccgtctcgagc

SEQ ID NO: 656 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgacttatgagatgctttgggtccgccaggctccagggaagggtctagagtgggtctcatctatttcttcttctggtaattatacatactacgcagactccgtgaagggccggttcaccatctcccgcgacaattccaagaacacgctgtatctgcaaatgaacagcctgcgtgccgaggacaccgcggtatattactgtgcgaaagagccgctgatgtttgactactggggtcagggaaccctggtcaccgtctcgagc

SEQ ID NO: 657 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatactgaggagatgagttgggtccgccaggctccagggaagggtctagagtgggtctcagcgattagtcctaatggtgcttttacattctacgcagactccgtgaagggccggttcaccatctcccgcgacaattccaagaacacgctgtatctgcaaatgaacagcctgcgtgccgaggacaccgcggtatattactgtgcgaaagagcctattctgtttgactactggggtcagggaaccctggtcaccgtctcgagc

SEQ ID NO: 658 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtcattatgatatggtttgggtccgccaggctccagggaggggtctagagtgggtctcaactattaatggtgctggtctgaatacatactacgcagactccgtgaagggccggttcaccatctcccgcgacaattccaagaacacgctgtatctgcaaatgaacagcctgcgtgccgaggacaccgcggtatattactgtgcgcaaagtgctagtcgtatttttgactactggggtcagggaaccctggtcaccgtctcgagc

SEQ ID NO: 659 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaggagttatgagatggcgtgggtccgccaggctccagggaagggtctagagtgggtctcatctattagtactctgggtacgaagacatactacgcagactccgtgaagggccggttcaccatctcccgcgacaattccaagaacacgctgtatctgcaaatgaacagcctgcgtgccgaggacaccgcggtatattactgtgcgcaatcttctactcatatttttgactactggggtcagggaaccctggtcaccgtctcgagc

SEQ ID NO: 660 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttattaggtatgagatggcttgggtccgccaggctccagggaagggtctagagtgggtctcaagtatttcgtcgtctggttggacgacatactacgcagactccgtgaagggccggttcaccatctcccgcgacaattccaagaacacgctgtatctgcaaatgaacagcctgcgtgccgaggataccgcggtatattactgtgcgaaaagtgatgctcatatttttgactactggggtcagggaaccctggtcaccgtctcgagc

SEQ ID NO: 661 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttatgcttatgagatggcttgggtccgccaggctccagggaagggtctagagtgggtctcatctatttcggatgatggtacgcggacatactacgcagactccgtgaagggccggttcaccatctcccgcgacaattccaagaacacgctgtatctgcaaatgaacagcctgcgtgccgaggacaccgcggtatattactgtgcgaaagatctggggcaggggtttgactactggggtcagggaaccctggtcaccgtctcgagc

SEQ ID NO: 662 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgatcatgggatgacgtgggtccgccaggctccagggaagggtctagagtgggtctcagggattggtccgtctggtgaggcgacatactacgcagactccgtgaagggccggttcaccatctcccgcgacaattccaagaacacgctgtatctgcaaatgaacagcctgcgtgccgaggacaccgcggtatattactgtgcgaaagatcgtattcctaatcttgtgtttgactactggggtcagggaaccctggtcaccgtctcgagc

SEQ ID NO: 663 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtctcaggatatgtcttgggtccgccaggctccagggaagggtctagagtgggtctcaggtattagtccgaatggttgggatacatactacgcagactccgtgaagggccggttcaccatctcccgcgacaattccaagaacacgctgtatctgcaaatgaacagcctgcgtgccgaggataccgcggtatattactgtgcgaaagataggtctgattttgactactggggtcagggaaccctggtcaccgtctcgagc

SEQ ID NO: 664 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggattatgatatgtggtgggtccgccaggctccagggaagggtctagagtgggtctcaaggattcgtcatccgggtggtgttacatactacgcagactccgtgaagggccggttcaccatctcccgcgacaattccaagaacacgctgtatctgcaaatgaacagcctgcgtgccgaggacaccgcggtatattactgtgcgaaagctgttcctaagggttttgactactggggtcagggaaccctggtcaccgtctcgagc

SEQ ID NO: 665 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggtttattggatgacttgggtccgccaggctccagggaagggtctagagtgggtctcatctattgatccgcagggtgggatgacatactacgcagactccgtgaagggccggttcaccatctctcgcgacaattccaagaacacgctgtatctgcaaatgaacagcctgcgtgccgaggataccgcggtatattactgtgcgaaagcgcgtattcctaatttggagtttgactactggggtcagggaaccctggtcaccgtctcgagc

SEQ ID NO: 666 - DNA, 357 bp, Artificial Sequence
  Description of Artificial Sequence: Synthetic polynucleotide
gaggtgcagctgttggagtctgggggaggcttggtacagcctggggagtccctgcgtctctcctgtgcagcctccggattcacctttagtgcttatgatatgacgtgggtccgccaggctccagggaagggtcttgagtgggtctcacgtattaatccgacgggttcttatacatactacgcagactccgtgaagggccggttcaccatctcccgcgacaattccaagaacacgctgtatctgcaaatgaacagcctgcgtgccgaggataccgcggtatattactgtgcgaaagctaagattccgaatttggtttttgactactggggtcagggaaccctggtcaccgtctcgagc

SEQ ID NO: 667 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcggatagtgagatgatgtgggtccgccaggctccagggaagggtctagagtgggtctcaggtattgcgcataatggtgggcatacatactacgcagactccgtgaagggccggttcaccatctcccgcgacaattccaagaacacgctgtatctgcaaatgaacagcctgcgtgccgaggacaccgcggtatattactgtgcgaaagctggtcatcctcagcagactgaggcttttgactactggggtcagggaaccctggtcaccgtctcgagc

SEQ ID NO: 668 - DNA, 348 bp, Artificial Sequence
  Description of Artificial Sequence: Synthetic polynucleotide
gagatgcagctgttggagtctgggggaggcttggtacagcctggggggtccctgcgtctctcctgtgcagcctccggattcacctttgctacttatgatatgtattgggtccgccaggctccagggaagggtctagagtgggtctcaaagatttctccgaatggttggagtacatactacgcagactccgtgaagggccggttcaccatctcccgcgacaattccaagaacacgctgtatctgcaaatgaacagcctgcgtgccgaggacaccgcggtatattactgtgcgaaatatcagacgcattttgactactggggtcagggaaccctggtcaccgtctcgagc

SEQ ID NO: 669 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgtttatgatatgaggtgggtccgccaggctccagggaagggtctagagtgggtctcaacgatttcttcttcgggtacgtatacatactacgcagactccgtgaagggccggttcaccatctcccgcgacaattccaagaacacgctgtatctgcaaatgaacagcctgcgtgccgaggacaccgcggtatattactgtgcgaaatatcctaagaattttgactactggggtcagggaaccctggtcaccgtctcgagc

SEQ ID NO: 670 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctcatgaggatatgacttgggtccgccaggctccagggaagggtctagagtgggtctcaagtattagtccgaatggttgggatacatactacgcagactccgtgaagggccggttcaccatctcccgcgacaattccaagaacacgctgtatctgcaaatgaacagcctgcgtgccgaggacaccgcggtatattactgtgcgaaacgtactaggagtaagtttgactactggggtcagggaaccctggtcaccgtctcgagc

SEQ ID NO: 671 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaagtatattatgggttgggcccgccaggctccagggaagggtctagagtgggtctcaacgattgattattggggtcagcatacatactacgcagactccgtgaagggccggttcactatctcccgcgacaattccaagaacacgctgtatctgcaaatgaacagcctgcgtgccgaggacaccgcggtatattactgtgcgaaacgtagtcatcttattcctctgcagtttgactactggggtcagggaaccctggtcaccgtctcgagc

SEQ ID NO: 672 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgattatgcgatggggtgggtccgccaggctccagggaagggtctggagtgggtctcaacgatttcgtatgtgggttattatacatactacgcagactccgtgaagggccggttcaccatctcccgcgacaattccaagaacacgctgtatctgcaaatgaacagcctgcgtgccgaggacaccgcggtatattactgtgcgaaaaaggctctgcggggggaggcgtttacggagcgttttgactactggggtcagggaaccctggtcaccgtctcgagc

SEQ ID NO: 673 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtccgtatatgatgcattgggtccgccaggctccagggaagggtctagagtgggtctcaacgattgaggttaatggtaataggacatactacgcagactccgtgaagggccggttcaccatctcccgcgacaattccaagaacacgctgtatctgcaaatgaacagcctgcgtgccgaggacaccgcggtatattactgtgcgaaatgggttggttcgaagacgtcgtcggataagagttttgactactggggtcagggaaccctggtcaccgtctcgagc

SEQ ID NO: 674 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtacgacggagatggcttgggtccgccaggctccagggaagggtctagagtgggtctcaagtattggtagtgctggtgcttggacatactacgcagactccgtgaagggccggttcaccatctcccgcgacaattccaagaacacgctgtatctgcaaatgaacagcctgcgtgccgaggataccgcggtatattactgtgcgaaaattggtgggcatcctcagggtcagtttgactactggggtcagggaaccctggtcaccgtctcgagc

SEQ ID NO: 675 - DNA, 357 bp, Artificial Sequence
  Description of Artificial Sequence: Synthetic polynucleotide
gaggtgcagctgttggagtctgggggaggcttggtacagcctggggggtccctgcgcctctcctgtgcagcctccggattcacctttcctagggagtggatggcttgggtccgccaggctccagggaagggtctagagtgggtctcaagtattcagcctatgggtcagactacatactacgcagactccgtgaagggccggttcaccatctcccgcgacaattccaagaacacgctgtatctgcaaatgaacagcctgcgtgccgaggataccgcggtatattactgtgcgaaatattctcggaataaggggttttttgactactggggtcagggaaccctggtcaccgtctcgagc

SEQ ID NO: 676 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacgagtgagtatatggggtgggtccgccaggctccagggaagggtctagagtgggtctcatctattcagaggtatggtagtacgacatactacgcagactccgtgaagggccggttcaccatctcccgcgacaattccaagaacacgctgtatctgcaaatgaacagcctgcgtgccgaggataccgcggtatattactgtgcgaaacatgagtctaattgggagacttttgactactggggtcagggaaccctggtcaccgtctcgagc

SEQ ID NO: 677 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcggtgtatagtatgcagtgggtccgccaggctccagggaagggtctagagtgggtctcagcgattactcctaatggtactcggacatactacgcagactccgtgaagggccggttcaccatctcccgcgacaattccaagaacacgctgtatctgcaaatgaacagcctgcgtgccgaggacaccgcggtatattactgtgcgaaaactcttggtcggggttcttatcctggtgttgattttgactactggggtcagggaaccctggtcaccgtctcgagc

SEQ ID NO: 678 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgagttatgctatgacgtgggtccgccaggctccagggaagggtctggagtgggtctcacgtattacggcggatggtactgttacatactacgcagactccgtgaagggccggttcaccatctcccgcgacaattccaagaacacgctgtatctgcaaatgaacagcctgcgtgccgaggacaccgcggtatattactgtgcgaaaggttctattccgatgcttacgtttgactactggggtcagggaaccctggtcaccgtctcgagc

SEQ ID NO: 679 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgacttatgatatgatttgggtccgccaggctccagggaagggtctagagtgggtctcagctatttctcctaatggtactggtatatactacgcagactccgtgaagggccggttcaccatctcccgcgacaattccaagaacacgctgtatctgcaaatgaacagcctgcgtgccgaggacaccgcggtatattactgtgcgaaaaatcagagtgttcatcatgctgtttttgactactggggtcagggaaccctggtcaccgtctcgagc

SEQ ID NO: 680 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaattatgagatgacgtgggtccgccaggctccagggaagggtctagagtgggtctcacgtattgcgccgcatggtcggcttacatactacgcagactccgtgaagggccggttcaccatctcccgcgacaattccaagaacacgctgtatctgcaaatgaacagcctgcgtgccgaggataccgcggtatattactgtgcgaaaggtcagattccgatgcttgattttgactactggggtcagggaaccctggtcaccgtctcgagc

SEQ ID NO: 681 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgcattatatgatgatgtgggtccgccaggctccagggaagggtctagagtgggtctcaacgatttctcattttggtgatattacatactacgcagactccgtgaagggccggttcaccatctcccgcgacaattccaagaacacgctgtatctgcaaatgaacagcctgcgtgccgaggataccgcggtatattactgtgcgaaaaatgatatggtgatgaagaatggggggtttgactactggggtcagggaaccctggtcaccgtctcgagc

SEQ ID NO: 682 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaggtatgatatgagttgggtccgccaggctccagggaagggtctagagtgggtctcacgtattgattcgcggggttggtctacatactacgcagactccgtgaagggccggttcaccatctcccgcgacaattccaagaacacgctgtatctgcaaatgaacagcctgcgtgccgaggacaccgcggtatattactgtgcgaaagggttggtgccgcatctgaggtttgactactggggtcagggaaccctggtcaccgtctcgagc

SEQ ID NO: 683 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgaatgcgcagatgacttgggtccgccaggctccagggaagggtctagagtgggtctcaaggattgatgctatgggtgatgctacatactacgcagactccgtgaagggccggttcaccatctcccgcgacaattccaagaacacgctgtatctgcaaatgaacagcctgcgtgccgaggacaccgcggtatattactgtgcgaaaggtaaggttccgagtattgactactggggtcagggaaccctggtcaccgtctcgagc

SEQ ID NO: 684 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgaatgcgcagatgacttgggtccgccaggctccagggaagggtctagagtgggtctcaaggattgatgctatgggtgatgctacatactacgcagactccgtgaagggccggttcaccatctcccgcgacaattccaagaacacgctgtatctgcaaatgaacagcctgcgtgccgaggataccgcggtatattactgtgcgaaaggtgttattccggcgtttgactactggggtcagggaaccctggtcaccgtctcgagc

SEQ ID NO: 685 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcagaatgatcggatgcattgggtccgccaggctccagggaagggtctagagtgggtctcatcgatttctgctactggtggtgatacatactacgcagactccgtgaagggccggttcaccatctcccgcgacaattccaagaacacgctgtatctgcaaatgaacagcctgcgtgccgaggacaccgcggtatattactgtgcgaaacagacgggtacgaatcgttttgactactggggtcagggaaccctggtcaccgtctcgagc

SEQ ID NO: 686 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatcagccttatatgtcgtgggtccgccaggctccagggaagggtctggagtgggtctcatctattgatgcttcgggtggtactacatactacgcagactccgtgaagggccggttcaccatctcccgcgacaattccaagaacacgctgtatctgcaaatgaacagcctgcgtgccgaggacgccgcggtatattactgtgcgaaagatcgtattcctaatcttgtgtttgactactggggtcagggaaccctggtcaccgtctcgagc

SEQ ID NO: 687 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatgagaatatgacttgggtccgccaggctccagggaagggtctagagtgggtctcacgtattgatggtgggggttataatacatactacgcagactccgtgaagggccggttcaccatctcccgcgacaattccaagaacacgctgtatctgcaaatgaacagcctgcgtgccgaggacaccgcggtatattactgtgcgaaagggcaggttcctgagctgctgtttgactactggggtcagggaaccctggtcaccgtctcgagc

SEQ ID NO: 688 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgtttcgtcgaatatgacttgggtccgccaggctccagggaagggtctagagtgggtctcagctattagtggtagtggtggtagcacatactatgcagactccgtgaagggccggttcaccatctcccgcgacaattccaagaacacgctgtatctgcaaatgaacagcctgcgtgccgaggacaccgcggtatattactgtgcgaaaggtcggattcctacgttggtgtttgactactggggtcagggaaccctggtcaccgtctcgagc

SEQ ID NO: 689 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgtttcgtcgaatatgacttgggtccgccaggctccagggaagggtctagagtgggtctcagctattagtggtagtggtggtagcacatactatgcagactccgtgaagggccggttcaccatctcccgcgacaattccaagaacacgctgtatctgcaaatgaacagcctgcgtgccgaggacaccgcggtatattactgtgcgaaagatcgtattcctaatcttgtgtttgactactggggtcagggaaccctggtcaccgtctcgagc

SEQ ID NO: 690 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgatgattcgatgagttgggtccgccaggctccagggaagggtctagagtgggtctcacgtattaatgatgctggtagttctacatactacgcagactccgtgaagggccggttcaccatctcccgcgacaattccaagaacacgctgtatctgcaaatgaacagcctgcgtgccgaggacaccgcggtatattactgtgcgaaaggtactattcctcttctggagtttgactactggggtcagggaaccctggtcaccgtctcgagc

SEQ ID NO: 691 - DNA, 357 bp, Artificial Sequence
  Description of Artificial Sequence: Synthetic polynucleotide
gagatgcagctgttggagtctgggggaggcttggtacagcctggggggtccctgcgtctctcctgtgcagcctccggattcacctttgtttcggatactatgagttgggtccgccaggctccagggaagggtctagagtgggtctcacgtattgatgggactggtggtgatacatactacgcagactccgtgaagggccggttcaccatctcccgcgacaattccaagaacacgctgtatctgcaaatgaacagcctgcgtgccggggacaccgcggtatattactgtgcgaaagggcttattcctgatcttcagtttgactactggggtcagggaaccctggtcaccgtctcgagc

SEQ ID NO: 692 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgaggaggagatgacgtgggtccgccaggctccagggaagggtctagagtgggtctcacgtattattggtggtggtcatgagacatactacgcagactccgtgaagggccggttcaccatctcccgcgacaattccaagaacacgctgtatctgcaaatgaacagcctgcgtgccgaggacaccgcggtatattactgtgcgaaaggtactattcctcttctggagtttgactactggggtcagggaaccctggtcaccgtctcgagc

SEQ ID NO: 693 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatgagaatatgacttgggtccgccaggctccagggaaggatctagagtgggtctcacggattactgagaggggtgatgtgacatactacgcagactccgtgaagggccggttcaccatctcccgcgacaattccaagaacacgctgtatctgcaaatgaacagcctgcgtgccgaggacaccgcggtatattactgtgcgaaaggtactgttcctacgctggagtttgactactggggtcagggaaccctggtcaccgtctcgagc

SEQ ID NO: 694 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgaggaggagatgacgtgggtccgccaggctccagggaagggtctagagtgggtctcacgtattattggtggtggtcatgagacatactacgcagactccgtgaagggccggttcaccatctcccgcgacaattccaagaacacgctgtatctgcaaatgaacagcctgcgtgccgaggacaccgcggtatattactgtgcgaaaggtactgttcctacgctggagtttgactactggggtcagggaaccctggtcaccgtctcgagc

SEQ ID NO: 695 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcatgagacggagatgacgtgggtccgccaggctccagggaagggtctagagtgggtctcagctattaatcggctgggtcaggatacatactacgcagactccgtgaagggccggttcaccatctcccgcgacaattccaagaacacgctgtatctgcaaatgaacagcctgcgtgccgaggacaccgcggtatattactgtgcgaaaggtaggattcctgggctggtttttgactactggggtcagggaaccctggtcaccgtctcgagc

SEQ ID NO: 696 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgatgattcgatgagttgggtccgccaggctccagggaagggtctagagtgggtctcacgtattaatgatgctggtagttctacatactacgcagactccgtgaagggccggttcaccatctcccgcgacaattccaagaacacgctgtatctgcaaatgaacagcctgcgtgccgaggacaccgcggtatattactgtgcgaaaggtactgttcctacgctggagtttgactactggggtcagggaaccctggtcaccgtctcgagc

SEQ ID NO: 697 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataatgagaatatgacttgggtccgccaggctccagggaaggatctagagtgggtctcacggattactgagaggggtgatgtgacatactacgcagactccgtgaagggccggttcaccatctcccgcgacaattccaagaacacgctgtatctgcaaatgaacagcctgcgtgccgaggacaccgcggtatattactgtgcgaaaggtcggattcctacgttggtgtttgactactggggtcagggaaccctggtcaccgtctcgagc

SEQ ID NO: 698 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgatgattcgatgagttgggtccgccaggctccagggaagggtctagagtgggtctcacgtattaatgatgctggtagttctacatactacgcagactccgtgaagggccggttcaccatctcccgcgacaattccaagaacacgctgtatctgcaaatgaacagcctgcgtgccgaggacaccgcggtatattactgtgcgaaagggattactcctaatttgacttttgactactggggtcagggaaccctggtcaccgtctcgagc

SEQ ID NO: 699 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgatgagccgatgacttgggtccgccaggctccagggaagggtctagagtgggtctcacgtattcctcctgagggtgctccgacatactacgcagactccgtgaagggccggttcaccatctcccgcgacaattccaagaacacgctgtatctgcaaatgaacagcctgcgtgccgaggacaccgcggtatattactgtgcgaaagggcttattcctgatcttcagtttgactactggggtcagggaaccctggtcaccgtctcgagc

SEQ ID NO: 700 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcaggatagtgatatgacgtgggtccgccaggctccagggaagggtctagagtgggtctcagctattgctgcgcctggtggtagtacatactacgcagactccgtgaagggccggttcaccatctcccgcgacaattccaagaacacgctgtatctgcaaatgaacagcctgcgtgccgaggacaccgcggtatattactgtgcgaaagatcgtattcctaatcttaggtttgactactggggtcagggaaccctggtcaccgtctcgagc

SEQ ID NO: 701 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgtttcggatactatgagttgggtccgccaggctccagggaagggtctagagtgggtctcacgtattgatgggactggtggtgatacatactacgcagactccgtgaagggccggttcaccatctcccgcgacaattccaagaacacgctgtatctgcaaatgaacagcctgcgtgccgaggacaccgcggtatattactgtgcgaaagggcaggttcctgagctgctgtttgactactggggtcagggaaccctggtcaccgtctcgagc

SEQ ID NO: 702 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcaggatagtgatatgacgtgggtccgccaggctccagggaagggtctagagtgggtctcagctattgctgcgcctggtggtagtacatactacgcagactccgtgaagggccggttcaccatctcccgcgacaattccaagaacacgctgtatctgcaaatgaacagcctgcgtgccgaggataccgcggtatattactgtgcgaaagatcgtattcctaatcttgtgtttgactactggggtcagggaaccctggtcaccgtctcgagc

SEQ ID NO: 703 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagccgccggattcacctttgatctggcggagatgacttgggtccgccaggctccagggaagggtctagagtgggtctcacgtattgatgaggatggtgcttctacatactacgcagactccgtgaagggccggttcaccatctcccgcgacaattccaagaacacgctgtatctgcaaatgaacagcctgcgtgccgaggacgccgcggtatattactgtgcggaaggtgttattccgtctctgacttttgactactggggtcagggaaccctggtcaccgtctcgagc

SEQ ID NO: 704 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactgataagcatatgagttgggtccgccaggctccagggaagggtctagagtgggtctcacggatttcgcctgatggtacgtatacatactacgcagactccgtgaagggccggttcaccatctcccgcgacaattccaagaacacgctgtatctgcaaatgaacagcctgcgtgccgaggacgccgcggtatattactgtgcggaaggtgttattccgtctctgacttttgactactggggtcagggaaccctggtcaccgtctcgagc

SEQ ID NO: 705 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgaggatgatatgacttgggtccgccaggctccagggaagggtctagagtgggtctcacgtattgcggttgatggtgatcggacatactacgcagactccgtgaagggccggttcaccatctcccgcgacaattccaagaacacgctgtatctgcaaatgaacagcctgcgtaccgaggacaccgcggtatattactgtgcgaaagggaagacgccgcatcttgtgtttgactactggggtcagggaaccctggtcaccgtctcgagc

SEQ ID NO: 706 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagccgccggattcacctttgatctggcggagatgacttgggtccgccaggctccagggaagggtctagagtgggtctcacgtattgatgaggatggtgcttctacatactacgcagactccgtgaagggccggttcaccatctcccgcgacaattccaagaacacgctgtatctgcaaatgaacagcctgcgtgccgaggacaccgcggtatattactgtgcgaaaggtcaggttcctgctttggtttttgactactggggtcagggaaccctggtcaccgtctcgagc

SEQ ID NO: 707 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattcgatgatgtcgtgggtccgccaggcgccagggaagggtctagagtgggtctcacggattgatcctgggggtgctcagacatactacgcagactccgtgaagggccggttcaccatctcccgcgacaattccaagaacacgctgtatctgcaaatgaacagcctgcgtgccgaggacaccgcggtatattactgtgcgaaaggggtgactccggatttgacttttgactactggggtcagggaaccctggtcaccgtctcgagc

SEQ ID NO: 708 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcatgcggatatgagttgggtccgccaggcttcagggaagggtctagagtgggtctcacgtattgataatagtggtcagtctacatactacgcagactccgtgaagggccggttcaccatctcccgcgacaattccaagaacacgctgtatctgcaaatgaacagcctgcgtgccgaggacaccgcggtatattactgtgcgaaaggggtgactccggatttgacgtttgactactggggtcagggaaccctggtcaccgtctcgagc

SEQ ID NO: 709 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgaggcggagatgaattgggtccgccaggctccagggaagggtctagagtgggtctcacgtattacgacggatggtgattctacatactacgcagactccgtgaagggccggttcaccatctcccgcgacaattccaagaacacgctgtatctgcaaatgaacagcctgcgtgccgaggacaccgcggtatattactgtgcgaaagggcgtattcctactcttcattttgactactggggtcagggaaccctggtcaccgtctcgagc

SEQ ID NO: 710 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctcaggattcacctttgatgatagtgatatgacttgggtccgccaggctccagggaagagtctagagtgggtctcatatattcggggtgatgatgatgagacatactacgcagactccgtgaagggccggttcaccatctcccgcgacaattccaagaacacgctgtatctgcaaatgaacagcctgcgtgccgaggacaccgcggtatattactgtgcgaaaaatcggattcctgatcttgtgtttgactactggggtcagggaaccctggtcaccgtctcgagc

SEQ ID NO: 711 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatgtggcggatatgcagtgggtccgccaggctccagggaagggtctagagtgggtctcaagtattagtccgaatggttgggatacatactacgcagactccgtgaagggccggttcaccatctcccgcgacaattccaagaacacgctgtatctgcaaatgaacagcctgcgtgccgaggacaccgcggtatattactgtgcgaaacatgcttctacggaggggccgactgcttttgactactggggtcagggaaccctggtcaccgtctcgagc

SEQ ID NO: 712 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggccgtatgatatggggtgggtccgccaggctccagggaagggtctggagtgggtctcatggatttctgctcatggttcgtttacatactacgcagactccgtgaagggccggttcaccatctcccgcgacaattccaagaacacgctgtatctgcaaatgaacagcctgcgtgccgaggataccgcggtatattactgtgcgaaatggccttataagtttgactactggggtcagggaaccctggtcaccgtctcgagc

SEQ ID NO: 713 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggagtgggtctatgagttgggtccgccaggctccagggaagggtctagagtgggtctcacggattggtagtaatggtgcggatacatactacgcagactccgtgaagggccggttcaccatctcccgcgacaattccaagaacacgctgtatctgcaaatgaacagcctgcgtgccgaggacaccgcggtatattactgtgcgaaagggatggttcctaatttggtttttgactactggggtcagggaaccctggtcaccgtctcgagc

SEQ ID NO: 714 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatcgttttgatatgacgtgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggacaccgcggtatattactgtgcgaaagatcgtattcctaatcttgtgtttgactactggggtcagggaaccctggtcaccgtctcgagc

SEQ ID NO: 715 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggagagtgatatgaagtgggtccgccaggctccagggaagggtctagagtgggtctcaagtattagtccgaatggttgggatacatactacgcagactccgtgaagggccggttcaccatctcccgcgacaattccaagaacacgctgtatctgcaaatgaacagcctgcgtgccgaggacaccgcggtatattactgtgcgaaatctccttcttctcgtcttaagtttgactactggggtcagggaaccctggtcaccgtctcgagc

SEQ ID NO: 716 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatagtagtgagatgagttgggtccgccaggctccagggaagggtctagagtgggtctcatcgattgagaatcagggtggtgcgacatactacgcagactccgtgaagggccggttcaccatctcccgcgacaattccaagaacacgctgtatctgcaaatgaacagcctgcgtgccgaggataccgcggtatattactgtgcgaaagatcgtattcctaatcttgtgtttgactactggggtcagggaaccctggtcaccgtctcgagc

SEQ ID NO: 717 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacccttgatgcgtatcctatgtattgggtccgccaggctccagggaagggtctagagtgggtctcatggattgcttcgggtggtggtgcgacatactacgcagactccgtgaagggccggttcaccatctcccgcgacaattccaagaacacgctgtatctgcaaatgaacagcctgcgtgccgaggacaccgcggtatattactgtgcgaaacgtacgaagaattttgactactggggtcagggaaccctggtcaccgtctcgagc

SEQ ID NO: 718 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttatgagttattctatggcttgggtccgccaggctccagggaagggtctagagtgggtctcagggattacttctaatggtaatcggacatactacgcagactccgtgaagggccggttcaccatctcccgcgacaattccaagaacacgctgtatctgcaaatgaacagcctgcgtgccgaggataccgcggtatattactgtgcgaaatcgactggggctaatagtaggaattttgactactggggtcagggaaccctggtcaccgtctcgagc

SEQ ID NO: 719 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggggtatctgatgtcgtgggtccgccaggctccagggaagggtctagagtgggtctcaagtattgcggctaatggtatgcagacatactacgcagactccgtgaagggccggttcaccatctcccgcgacaattccaagaacacgctgtatctgcaaatgaacagcctgcgtgccgaggacaccgcggtatattactgtgcgaaaaagccgaggggtatttgggatggggattttgactactggggtcagggaaccctggtcaccgtctcgagc

SEQ ID NO: 720 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcatgagtctacgatgacgtgggtccgccaggctccagggaagggtctagagtgggtctcaactattcggcatccgggtgagtttacatactacgcagactccgtgaagggccggttcaccatctcccgcgacaattccaagaacacgctgtatctgcaaatgaacagcctgcgtgccggggacaccgcggtatattactgtgcgaaagggcttattcctgatcttcagtttgactactggggtcagggaaccctggtcaccgtctcgagc

SEQ ID NO: 721 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgatgtatagtatgagttgggtccgccaggctccagggaagggtctagagtgggtctcatcgattgcgccgccgggtggtaggacatactacgcagactccgtgaagggccggttcaccatctcccgcgacaattccaagaacacgctgtatctgcaaatgaacagcctgcgtgccgaggataccgcggtatattactgtgcgaaacagtcgctgacggggtatagtaggtcttttgactactggggtcagggaaccctggtcaccgtctcgagc

SEQ ID NO: 722 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgcagaatccgatgtcgtgggtccgccacgctccagggaagggtctagagtgggtctcaacgattcctgcgaatggtcgtcctacatcctacgcagactccgtgaagggccggttcaccatctcccgcgacaattccaagaacacgctgtatctgcaaatgaacagcctgcgtgccgaggataccgcggtatattactgtgcgaaatatagtcagcagccgggtcgtcggtttgactactggggtcagggaaccctggtcaccgtctcgagc

SEQ ID NO: 723 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctaattatcatatgacgtgggtccgccaggctccagggaagggtctagagtgggtctcatcgattcctgatagtggtaagcagacatactacgcagactccgtgaagggccggttcaccatctcccgcgacaattccaagaacacgctgtatctacaaatgaacagcctgcgtgccgaggacaccgcggtatattactgtgcgaaaggtaggattccgtctcttctttttgactactggggtcagggaaccctggtcaccgtctcgagc

SEQ ID NO: 724 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgcagtatcatatgcgttgggtccgccaggctccagggaagggtctagagtgggtctcaacgattaatgatattggtagtaatacatactacgcagactccgtgaagggccggttcaccatctcccgcgacaattccaagaacacgctgtatctgcaaatgaacagcctgcgtgccgaggacaccgcggtatattactgtgcgaaagttggggggcgggggagtttttcttttgactactggggtcagggaaccctggtcaccgtctcgagc

SEQ ID NO: 725 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcttcgtatgatatgaagtgggtccgccaggctccagggaagggtctagagtgggtctcaacgattagtgcgtctggtgtgtttacatactacgcagactccgtgaagggccggttcaccatctcccgcgacaattccaagaacacgctgtatctgcaaatgaacagcctgcgtgccgaggacaccgcggtatattactgtgcgaaacgggagcatgcgggtcagccgccttttgactactggggtcagggaaccctggtcaccgtctcgagc

SEQ ID NO: 726 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatggttatgctatgagttgggtccgccaggctccagggaagggtctagagtgggtctcaactattaatgctaatggtaagtatacatactacgcagactccgtgaagggccggttcaccatctcccgcgacaattccaagaacacgctgtatctgcaaatgaacagcctgcgtgccgaggacaccgcggtatattactgtgcgaaaaagttgactcttgcttctaattattttgactactggggtcagggaaccctggtcaccgtctcgagc

SEQ ID NO: 727 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttatggattatgatatgaagtgggtccgccaggctccagggaagggtctagagtgggtctcaagtattactgcgcttggtaagaagacatactacgcagactccgtgaagggccggttcaccatctcccgcgacaattccaagaacacgctgtatctgcaaatgaacagcctgcgtgccgaggacaccgcggtatattactgtgcgaaagatagtgttaagtatcctcttaatctttttgactactggggtcagggaaccctggtcaccgtctcgagc

SEQ ID NO: 728 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgcattatacgatggcgtgggtccgccaggctccagggaagggtctggagtgggtctcatctattcagtcgcctggttggcggacatactacgcagactccgtgaagggccggttcaccatctcccgcgacaattccaagaacacgctgtatctgcaaatgaacagcctgcgtgccgaggataccgcggtatattactgtgcgaaatatggggatggtcttcctttgacttttgactactggggtcagggaaccctggtcaccgtctcgagc

SEQ ID NO: 729 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtggtacgccgatgtcttgggtccgccaggctccagggaagggtctagagtgggtctcacgtattggggatgagggtcaggagacatactacgcagactccgtgaagggccggttcaccatctcccgcgacaattccaagaacacgctgtatctgcaaatgaacagcctgcgtgccgaggacaccgcggtatattactgtgcgaaaggggtgactccggatttgacttttgactactggggtcagggaaccctggtcaccgtctcgagc

SEQ ID NO: 730 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtagtagttcgatgtcttgggtccgccaggctccagggaagggtctagagtgggtctcagcgattgggtctgatggtccgagtacatactacgcagactccgtgaagggccggttcaccatctcccgcgacaattccaagaacacgctgtatctgcaaatgaacagcctgcgtgccgaggacaccgcggtatattactgtgcgaaagggcgtattcctactcttcattttgactactggggtcagggaaccctggtcaccgtctcgagc

SEQ ID NO: 731 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatcctggtgagatgacgtgggtccgccaggctccagggaagggtctagagtgggtctcaagtattgatgggtctggttcttcgacatactacgcagactccgtgaagggccggttcaccatctcccgcgacaattccaagaacacgctgtatctgcaaatgaacagcctgcgtgccgatgacaccgcggtatattactgtgcgaaagggcgtattcctactcttcattttgactactggggtcagggaaccctggtcaccgtctcgagc

SEQ ID NO: 732 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctgagtctatgatggggtgggtccgccaggctccagggaagggtctagagtgggtctcatcgattgggtatcctggtgctactacatactacgcagactccgtgaagggccggttcaccatctcccgcgacaattccaagaacacgctgtatctgcaaatgaacagcctgcgtgccgaggataccgcggtatattactgtgcgaaaggtggtagtcgggatgataattttgactactggggtcagggaaccctggtcaccgtctcgagc

SEQ ID NO: 733 - DNA, 372 bp, Artificial Sequence
  Description of Artificial Sequence: Synthetic polynucleotide
gaggtgcagctgttggagtctgggggaggcttggtacagcctggggggtccctgcgcctctcctgtgcagcctccggattcacctttggtcagcatagtatgcattgggtccgccaggctccagggaagggtctagagtgggtctcaagtattagtgttccgggtccgaagacatactacgcagactccgtgaagggccggttcaccatctcccgcgacaattccaagaacacgctgtatctgcaaatgaacagcctgcgtgccgaggacaccgcggtatattactgtgcgaaaagtcttagggatttgcgtccgggtgatagtaagagttttgactactggggtcagggaaccctggtcaccgtctcgagc

SEQ ID NO: 734 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggttctgctgctatggattgggtccgccaggctccagggaagggtctagagtgggtctcatctattaatgatatgggttctaatacatactacgcagactccgtgaagggccggttcaccatctcccgcgacaattccaagaacacgctgtatctgcaaatgaacagcctgcgtgccgaggacaccgcggtatattactgtgcgaaacagggtggtcgttttgactactggggtcagggaaccctggtcaccgtctcgagc

SEQ ID NO: 735 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggttatgataggatggcttgggtccgccaggctccagggaagggtctagagtgggtctcatcgattgatggtcctggtggggctacatactacgcagactccgtgaagggccggttcaccatctcccgcgacaattccaagaacacgctgtatctgcaaatgaacagcctgcgtgccgaggacaccgcggtatattactgtgcggaagggaggagggttcctgattttgactactggggtcagggaaccctggtcaccgtctcgagc

SEQ ID NO: 736 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgagtatgagatgacttgggtccgccaggctccagggaagggtctagagtgggtctcaaggattgatccgtttggttctgagacatactacgcagactccgtgaagggccggttcaccatctcccgcgacaattccaagaacacgctgtatctgcaaatgaacagcctgcgtgccgaggacaccgcggtatattactgtgcggaaggtgtggttcctgatttgaattttgactactggggtcagggaaccctggtcaccgtctcgagc

SEQ ID NO: 737 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataagtatgttatggggtgggtccgccaggctccagggaagggtctagagtgggtctcaactattggtagttatggtggggctacatactacgcagactccgtgaagggccggttcaccatctcccgcgacaattccaagaacacgctgtatctgcaaatgaacagcctgcgtgccgaggacaccgcggtatattactgtgcgaaaaggcttactcttagtgcgactaagtttgactactggggtcagggaaccctggtcaccgtctcgagc

SEQ ID NO: 738 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattatgtgatgggttgggtccgccaggctccagggaagggtctagagtgggtctcaactattgcgcatcggggtgatattacatactacgcagactccgtgaagggccggttcaccatctcccgcgacaattccaagaacacgctgtatctgcaaatgaacagcctgcgtgccgaggacaccgcggtatattactgtgcgaaacgtaggcgtcttagtgattatcggtttgactactggggtcagggaaccctggtcaccgtctcgagc

SEQ ID NO: 739 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcagtttgatatgtattgggtccgccaggctccagggaagggtctagagtgggtctcagcgattagtccggctggtactggtacatactacgcagactccgtgaagggccggttcaccatctcccgcgacaattccaagaacacgctgtatctgcaaatgaacagcctgcgtgccgaggacaccgcggtatattactgtgcgaaagcgggggatcggtctagtctttttgactacaggggtcagggaaccctggtcaccgtctcgagc

SEQ ID NO: 740 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaaggatacgggtatgacgtgggtccgccaggctccagggaagggtctagagtgggtctcaagtatttctagttatggtcgtgatacatactacgcagactccgtgaagggccggttcaccatctcccgcgacaattccaagaacacgctgtatctgcaaatgaacagcctgcgtgccgaggacgccgcggtatattactgtgcgaaattgaatgcggcgctgggttttgactactggggtcagggaaccctggtcaccgtctcgagc

SEQ ID NO: 741 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtccgtatccgatgagttgggtccgccaggctccagggaagggtctagagtgggtctcaggtattaatgcgccgggtacgaggacatactacgcagactccgtgaagggccggttcaccatctcccgcgacaattccaagaacacgctgtatctgcaaatgaacagcctgcgtgccgaggacaccgcggtatattactgtgcgcaacagatgtctagtggggtttttgactactggggtcagggaaccctggtcaccgtctcgagc

SEQ ID NO: 742 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgaatcaggatatgacttgggtccgccaggctccagggaagggtctagagtgggtctcaagtattgatagttctggtcagcttacatactacgcagactccgtgaagggccggttcaccatctcccgcgacaattccaagaacacgctgtatctgcaaatgaacagcctgcgtgccgaggacaccgcggtatattactgtgcgaaagttaagtctcttgcgcggtttgactactggggtcagggaaccctggtcaccgtctcgagc

SEQ ID NO: 743 - DNA, 351 bp, Artificial Sequence
  Description of Artificial Sequence: Synthetic polynucleotide
gaggtgcagctgttggagtctgggggaggcttggtacagcctggggggtccctgcgtctctcctgcgcagcctccggattcacctttcctgagtctgatatgaagtgggtccgccaggctccagggaagggtctagagtgggtctcaagtattagtccgaatggttgggatacatactacgcagactccgtgaagggccggttcaccatctcccgcgacaattccaagaacacgctgtatctgcaaatgaacagcctgcgtgccgaggataccgcggtatattactgtgcgaaaccggctcaggttctgtttgactactggggtcagggaaccctggtcaccgtctcgagc

SEQ ID NO: 744 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcagtatgtgatgggttgggtccgccaggctccagggaagggtctagagtgggtctcaacgattggtacgtcgggtaagtatacatactacgcagactccgtgaagggccggttcaccatctcccgcgacaattccaagaacacgctgtatctgcaaatgaacagcctgcgtgccgaggacaccgcggtatattactgtgcgcaacgtaggtctctgactcgggttcattttgactactggggtcagggaaccctggtcaccgtctcgagc

SEQ ID NO: 745 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgtggagcatatgagttgggtccgccaggctccagggaagggtctagagtgggtctcagcgattacgggtgatggtgatcgtacatactacgcagactccgtgaagggccggttcaccatctcccgcgacaattccaagaacacgctgtatctgcaaatgaacagcctgcgtgccgaggacaccgcggtatattactgtgcgaaaacggtttcgtggaatggtcgttttgactactggggtcagggaaccctggtcaccgtctcgagc

SEQ ID NO: 746 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgtggtataatatgggttgggtccgccaggctccagggaagggtctggagtgggtctcaaggattgctccgtctggtattattacatactacgcagactccgtgaagggccggttcaccatctcccgcgacaattccaagaacacgctgtatctgcaaatgaacagcctgcgtgccgaggacaccgcggtatattactgtgcgaaagggttgcgtggtaagtttgactactggggtcagggaaccctggtcaccgtctcgagc

SEQ ID NO: 747 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgaattatgagatgaggtgggtccgccaggctccagggaagggtctagagtgggtctcatctatttcttcggctggtactgatacatactacgcagactccgtgaagggccggttcaccatctcccgcgacaattccaagaacacgctgtatctgcaaatgaacagcctgcgtgccgaggacaccgcggtatattactgtgcgaaacagtcgcttaattttgactactggggtcagggaaccctggtcaccgtctcgagc

SEQ ID NO: 748 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgtagcctccggattcacctttgatgaggagccgatgacttgggtccgccaggctccagggaagggtctagagtgggtctcaattattgatccgggtggtggggcgacatactacgcagactccgtgaagggccggttcaccatctcccgcgacaattccaagaacacgctgtatctgcaaatgaacagcctgcgtgccgaggacaccgcggtatattactgtgcgaaatctaatagtatgtttgactactggggtcagggaaccctggtcaccgtctcgagc

SEQ ID NO: 749 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgcgtatcctatgcattgggtccgccaggctccagggaagggtctagagtgggtctcatctattgcttcttcgggtattacgacatactacgcagactccgtgaagggccggttcaccatctcccgcgacaattccaagaacacgctgtatctgcaaatgaacagcctgcgtgccgaggacaccgcggtatattactgtgcgaaatttactcggctgcattttcctgcgcagtttgactactggggtcagggaaccctggtcaccgtctcgagc

SEQ ID NO: 750 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgattatgcgatgggttgggtccgccaggctccagggaagggtctagagtgggtctcaaggatttctcctgagggttctaggacatactacgcagactccgtgaagggccggttcaccatctcccgcgacaattccaagaacacgctgtatctgcaaatgaacagcctgcgtgccgaggacaccgcggtatattactgtgcgaaattgcggccgtatgcgtcgaagtttgactactggggtcagggaaccctggtcaccgtctcgagc

SEQ ID NO: 751 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaggccgtatgatatgggttgggtccgccaggctccagggaagggtctagagtgggtctcaacgatttctcatcagggtaatcggacatactacgcagactccgtgaagggccggttcaccatctcccgcgacaattccaagaacacgctgtatctgcaaatgaacagcctgcgtgccgaggacaccgcggtatattactgtgcgaaagtgtctcatcattttgactactggggtcagggaaccctggtcaccgtctcgagc

SEQ ID NO: 752 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctgcgtataatatgtggtgggcccgccaggctccagggaagggtttagagtgggtctcatggattaattcgactggttctcgtacatactacgcagactccgtgaagggccggttcaccatctcccgcgacaattccaagaacacgctgtatctgcaaatgaacagcctgcgtgccgaggataccgcggtatattactgtgcgaaaaattggcatcgggggaggtttgactactggggtcagggaaccctggtcaccgtctcgagc

SEQ ID NO: 753 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgataggtatcggatggggtgggtccgccaggctccagggaagggtctagagtgggtctcaacgattaatcggctgggtcagagtacatactacgcagactccgtgaagggccggttcaccatctcccgcgacaattccaagaacacgctgtatctgcaaatgaacagcctgcgtgccgaggacaccgcggtatattactgtgcgaaagtgaagaagcataagtttgactactggggtcagggaaccctggtcaccgtctcgagc

SEQ ID NO: 754 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgcattataatatgcggtgggtccgccaggctccagggaagggtctagagtgggtctcaacgattacgaagactggttttcgtacatactacgcagactccgtgaagggccggttcaccatctcccgtgacaattccaagaacacgctgtatctgcaaatgaacagcctgcgtgccgaggacaccgcggtatattactgtgcgaaagcggggcagtttgattttgactactggggtcagggaaccctggtcaccgtctcgagc

SEQ ID NO: 755 - DNA, 354 bp, Artificial Sequence
  Description of Artificial Sequence: Synthetic polynucleotide
gaggtgcagctgttggagtctgggggaggcttagtacagcctggggggtccctgcgtctctcctgtgcagcctccggattcaccttttatccttatagtatgcattgggtccgccaggctccagggaagggtctggagtgggtctcaactattgatggtagtggtatgtttacatactacgcagactccgtgaagggccggttcaccatctcccgcgacaattccaagaacacgctgtatctgcaaatgaacagcctgcgtgccgaggacaccgcggtatattactgtgcggaagattctctgaaggcttcttttgactactggggtcagggaaccctggtcaccgtctcgagc

SEQ ID NO: 756 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgctttatgggatgtggtgggtccgccaggctccagggaagggtctagagtgggtctcatatattgggccttatggtcatactacatactacgcagactccgtgaagggccggttcaccatctcccgcgacaattccaagaacacgctgtatctgcaaatgaacagcctgcgtgccgaggataccgcggtatattactgtgcgaaaaagcggaagaagaagtttgactactggggtcagggaaccctggtcaccgtctcgagc

SEQ ID NO: 757 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctaggtatcggatgagttgggtccgccaggctccagggaagggtctagagtgggtctcaagtattactccgtatggtgctcatacatactacgcagactccgtgaagggccggttcaccatctcccgcgacaattccaagaacacgctgtatctgcaaatgaacagcctgcgtgccgaggacaccgcggtatattactgtgcgaaatatggtaagtggtattttgactactggggtcagggaaccctggtcaccgtctcgagc

SEQ ID NO: 758 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatgagtatgcgatgaggtgggtccgccaggctccagggaagggtctagagtgggtctcaacgattgatcgtctgggtcttcatacatactacgcagactccgtgaagggccggttcaccatctcccgcgacaattccaagaacacgctgtatctgcaaatgaacagcctgcgtgccgaggacaccgcggtatattactgtgcgaaaagtgggccttttacgtttgactactggggtcagggaaccctggtcaccgtctcgagc

SEQ ID NO: 759 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagcggtataatatgcgttgggtccgccaggctccagggaagggtctagagtgggtctcaacgattgatcggctgggtcttgctacatactacgcagactccgtgaagggccggttcaccatctcccgcgacaattccaagaacacgctgtatctgcaaatgaacagcctgcgtgccgaggacaccgcggtatattactgtgcgaaagcgggttcgtggtcttttgactactggggtcagggaaccctggtcaccgtctcgagc

SEQ ID NO: 760 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtatttatgatatgaagtgggtccgccaggctccagggaagggtctagagtgggtctcaacgatttcgtcgtcgggtactcatacatactacgcagactccgtgaagggccggttcaccatctcccgcgacaattccaagaacacgctgtatctgcaaatgaacagcctgcgtgccgaggacaccgcggtatattactgtgcgaaatatcctcagccttatccttttgactactggggtcagggaaccctggtcaccgtctcgagc

SEQ ID NO: 761 - DNA, 354 bp, Artificial Sequence
  Description of Artificial Sequence: Synthetic polynucleotide
gaggtgcagctattggagtctgggggaggcttggtacagcctggggggtccctgcgtctctcctgtgcagcctccggattcaccttttgggtgtatgatatgcgttgggtccgccaggctccagggaagggtctagagtgggtctcaacgatttctgcgactggtgtgcatacatactacgcagactccgtgaagggccggttcaccatctcccgcgacaattccaagaacacgctgtatctgcaaatgaacagcctgcgtgccgaggacaccgcggtatattactgtgcgaaatatccgcctgctggtcggtttgactactggggtcagggaaccctggtcaccgtctcgagc

SEQ ID NO: 762 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgacttatgatatgatttgggtccgccaggctccagggaagggtctagagtgggtctcagctatttctcctaatggtactggtacatactacgcagactccgtgaagggccggttcaccatctcccgcgacaattccaagaacacgctgtatctgcaaatgaacagcctgcgtgccgaggacaccgcggtatattactgtgcgaaacctccgcaggtgaatactgagtttgactaccggggtcagggaaccctggtcaccgtctcgagc

SEQ ID NO: 763 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaaggaggatatggggtgggtccgccaggctccagggaagggtctagagtgggtctcacatatttcgccgaatggttatgcgacatactacgcagactccgtgaagggccggttcaccatctcccgcgacaattccaagaacacgctgtatctgcaaatgaacagcctgcgtgccgaggacaccgcggtatattactgtgcgaaaagttggtctagttttgactactggggtcagggaaccctggtcaccgtctcgagc

SEQ ID NO: 764 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgctactccgatggagtgggcccgccaggctccagggaagggtctagagtgggtctcaactatttctgagagtggttatagtacatactacgcagactccgtgaagggccggttcaccatctcccgcgacaattccaagaacacgctgtatctgcaaatgaacagcctgcgtgccgaggacaccgcggtatattactgtgcgaaatggaattcgactactggttttgactactggggtcagggaaccctggtcaccgtctcgagc

SEQ ID NO: 765 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatacggtggatatggagtgggtccgccaggctccagggaagggtctagagtgggtctcaagtattagtccgaatggttgggatacatactacgcagactccgtgaagggccggttcaccatctcccgcgacaattccaagaacacgctgtatctgcaaatgaacagcctgcgtgccgaggacaccgcggtatattactgtgcggaagctccgcatcgggcgtttgactactggggtcagggaaccctggtcaccgtctcgagc

SEQ ID NO: 766 - DNA, 357 bp, Artificial Sequence
  Description of Artificial Sequence: Synthetic polynucleotide
gaggtgcagctgttggagtctggggggggcttggtacagcctggggggtccctgcgtctctcctgtgcagcctccggattcacctttgaggataaggagatgagttgggtccgccaggctccagggaagggtctagagtgggtctcacggattgatgctttgggtgattctacatactacgcagactccgtgaagggccggttcaccatctcccgcgacaattccaagaacacgctgtatctgcaaatgaacagcctgcgtgccgaggacaccgcggtatattactgtgcggaagggatggttcctcgtctgaagtttgactactggggtcagggaaccctggtcaccgtctcgagc

SEQ ID NO: 767 - DNA, 342 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgatcattcgatgatgtgggtccgccaggctccagggaagggtctagagtgggtctcagatattgagccgcatggtgttcatacatactacgcagactccgtgaagggccggttcaccatctcccgcgacaattccaagaacacgctgtatctgcaaatgaacagcctgcgtgccgaggacaccgcggtatattactgtgcgaatcctacttttgactactggggtcagggaaccctggtcaccgtctcgagc

SEQ ID NO: 768 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgccgcatactatgcattgggtccgccaggctccagggaagggtctagagtgggtctcaggtattggtccggatggtactactacatactacgcagactccgtgaagggccggttcaccatctcccgcgacaattccaagaacacgctgtatctgcaaatgaacagcctgcgtgccgaggacaccgcggtatattactgtgcgaaacgttcgtatagttgggatcgtgggtggacgtttgactactggggtcagggaaccctggtcaccgtctcgagc

SEQ ID NO: 769 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttatgcttcggatatgaagtgggtccgccaggctccagggaagggtctagagtgggtctcaagtattagtccgaatggttgggatacatactacgcagactccgtgaagggccggttcaccatctcccgcgacaattccaagaacacgctgtatctgcaaatgaacagcctgcgtgccgaggacaccgcggtatattactgtgcgaaagctgattatacttatcattcttttgactactggggtcaggggaccctggtcaccgtctcgagc

SEQ ID NO: 770 - DNA, 351 bp, Artificial Sequence; identical to SEQ ID NO: 754
  Description of Artificial Sequence: Synthetic polynucleotide

SEQ ID NO: 771 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgcattatcatatgggttgggcccgccaggctccagggaagggtctagagtgggtctcagttattgggccgaggggtatttctacatactacgcagactccgtgaagggccggttcaccatctcccgcgacaattccaagaacacgctgtatctgcaaatgaacagcctgcgtgccgaggacaccgcggtatattactgtgcgaaatcgccttcgcgtcataggtttgactactggggtcagggaaccctggtcaccgtctcgagc

SEQ ID NO: 772 - DNA, 351 bp, Artificial Sequence; identical to SEQ ID NO: 758
  Description of Artificial Sequence: Synthetic polynucleotide

SEQ ID NO: 773 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaattatagtatgaagtgggcccgccaggctccagggaagggtctagagtgggtctcaactattactcctgatggttggtatacatactacgcagactccgtgaagggccggttcaccatctcccgcgacaattccaagaacacgctgtatctgcaaatgaacagcctgcgtgccgaggacaccgcggtatattactgtgcgaaagtgggggatgctgtttgggggtggattggtgggtttgactactggggtcagggaaccctggtcaccgtctcgagc

SEQ ID NO: 774 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggattatggtatgaagtgggtccgccaggctccagggaagggtctagagtgggtctcagctattacgtctaatggtgattttacatactacgcagactccgtgaagggccggttcaccatctcccgcgacaattccaagaacacgctgtatctgcaaatgaacagcctgcgtgccgaggacaccgcggtatattactgtgcgaaatctttgtataagtttgactactggggtcagggaaccctggtcaccgtctcgagc

SEQ ID NO: 775 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcaggctccggattcacctttcctacttataagatggggtgggtccgccaggctccagggaagggtctagagtgggtctcatttattgattattggggttggcggacatactacgcagactccgtgaagggccggttcaccatctcccgcgacaattccaagaacacgctgtatctgcaaatgaacagcctgcgtgccgaggacaccgcggtatattactgtgcgaaaagtccgtattcttggactcatgatagtcctcattttgactactggggtcagggaaccctggtcaccgtctcgagc

SEQ ID NO: 776 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaggccttatacgatgtgttgggcccgccaggctccagggaagggtctagagtgggtctcatgtattagtgatgctggttcttttacatactacgcagactccgtgaagggccggttcaccatctcccgcgacaattccaagaacacgctgtatctgcaaatgaacagcctgcgtgccgaggataccgcggtatattactgtgcgaaaaggatgtcttcttttgactactggggtcagggaaccctggtcaccgtctcgagc

SEQ ID NO: 777 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcagaattatcagatggcttgggtccgccaggctccagggaagggtctagagtgggtctcaactattagtgggactggtaagaatacatactacgcagactccgtgaagggccggttcaccatctcccgcgacaattccaagaacacgctgtatctgcaaatgaacagcctgcgtgccgaggacaccgcggtatattactgtgcgaaaactcctcagaattattttagtgtgcgtcggtttgactactggggtcagggaaccctggtcaccgtctcgagc

SEQ ID NO: 778 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggcgtatactatggggtgggtccgccaggctccagggaagggtctagagtgggtctcaaagatttcgacgtctggtgggcagacatactacgcagactccgtgaagggccggttcaccatctcccgcgacaattccaagaacacgctgtatctgcaaatgaacagcctgcgtgccgaggacaccgcggtatattactgtgcgaaacctttgaattggtgggcgtttgactactggggtcagggaaccctggtcaccgtctcgagc

SEQ ID NO: 779 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatgcgtatcctatgacttgggtccgccaggctccagggaagggtctagagtgggtctcacggattgatggttatggtcggcatacatactacgcagactccgtgaagggccggttcaccatctcccgcgacaattccaagaacacgctgtatctgcaaatgaacagcctgcgtgccgaggacaccgcggtatattactgtgcgaaagggattattcctaattttgactactggggtcagggaaccctggtcaccgtctcgagc

SEQ ID NO: 780 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggcggttgatatgacgtgggtccgccaggctccagggaagggtctagagtgggtctcagcgatttcgcctagtggttctgctacatactacgcagactccgtgaagggccggttcaccatctcccgcgacaattccaagaacacgctgtatctgcaaatgaacagcctgcgtgccgaggacaccgcggtatattactgtgcgaaagggcgtgtgccggatcttggttttgactactggggtcagggaaccctggtcaccgtctcgagc

SEQ ID NO: 781 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatagttatgcgatggggtgggcccgccaggctccagggaagggtctagagtgggtctcagctattggggctaagggtttgtctacatactacgcagactccgtgaagggccggttcaccatctcccgcgacaattccaagaacacgctgtatctgcaaatgaacagcctgcgtgccgaggacaccgcggtatattactgtgcgaaagcggctaggggtaagtttgactactggggtcagggaaccctggtcaccgtctcgagc

SEQ ID NO: 782 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactcggtatcagatgggttgggtccgccaggctccagggaagggtctagagtgggtctcagttattaatgtttggggttcgagtacatactacgcagactccgtgaagggccggttcaccatctcccgcgacaattccaagaacacgctgtatctgcaaatgaacagcctgcgtgccgaggacaccgcggtatattactgtgcgaaaatgtctgggaagtttgcctactggggtcagggaaccctggtcaccgtctcgagc

SEQ ID NO: 783 - DNA, 351 bp, Artificial Sequence
  Description of Artificial Sequence: Synthetic polynucleotide
gaggtgcagctgttggagtctgggggaggcttggtacagcctggggggtccctgcgtctttcctgtgcagcctccggattcacctttgggaattatagtatgatgtgggtccgccaggctccagggaagggtctagagtgggtctcaacgattattcctgctggtacgtctacatactacgcagactccgtgaagggccggttcaccatctcccgcgacaattccaagaacacgctgtatctgcaaatgaacagcctgcgtgccgaggacaccgcggtatattactgtgcgaaaccgtcgattaggttgtttgactactggggtcagggaaccctggtcaccgtctcgagc

SEQ ID NO: 784 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgcgtatgatatggggtgggtccgccaggctccagggaagggtctagagtgggtctcatggatttctccgaatggttatgatacatactacgcagactccgtgaagggccggttcaccatctcccgcgacaattccaagaacacgctgtatctgcaaatgaacagcctgcgtgccgaggacaccgcggtatattactgtgcgaaagggggtgtgaagtttgactactggggtcagggaaccctggtcaccgtctcgagc

SEQ ID NO: 785 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgtttggtatgagatggcttgggtccgccaggctccagggaagggtctagagtgggtctcaacgattcaggctgatggtgagcagacatactacgcagactccgtgaagggccggttcaccatctcccgcgacaattccaagaacacgctgtatctgcaaatgaacagcctgcgtgccgaggataccgcggtatattactgtgcgaaagcttcgtatgctcttgtgtatcctcctgaggagtttgactactggggtcagggaaccctggtcaccgtctcgagc

SEQ ID NO: 786 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacgaattataggatgtcttgggtccgccaggctccagggaagggtctagagtgggtctcagctattgatgatctgggtgtgtcgacatactacgcagactccgtgaagggccggttcaccatctcccgcgacaattccaagaacacgctgtatctgcaaatgaacagcctgcgtgccgaggacaccgcggtatattactgtgcgaaatggaggcttaagaatagtcagccgacggattttgactactggggtcagggaaccctggtcaccgtctcgagc

SEQ ID NO: 787 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatcaggctcatatgtggtgggtccgccaggctccagggaagggtctagagtgggtctcatttattaatccttcgggttattatacatactacgcagactccgtgaagggccggttcaccatctcccgcgacaattccaagaacacgctgtatctgcaaatgaacagcctgcgtgccgaggacaccgcggtatattactgtgcgaaaccttcgcttagtccgtcttcttttgactactggggtcagggaaccctggtcaccgtctcgagc

SEQ ID NO: 788 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagactggtcagatgggttgggcccgccaggctccagggaagggtctagagtgggtctcaaatattgatgggtctggtacgtatacatactacgcagactccgtgaagggccggttcaccatctcccgcgacaattccaagaacacgctgtatctgcaaatgaacagcctgcgtgccgaggacaccgcggtatattactgtgcgaaaagtacgcagaattatcggtttgactactggggtcagggaaccctggtcaccgtctcgagc

SEQ ID NO: 789 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgcttatccgatgtattgggtccgccaggctccagggaagggtctagagtgggtctcatctattcataaggatggtaggattacatactacgcagactccgtgaagggccggttcaccatctcccgcgacaattccaagaacacgctgtatctgcaaatgaacagcctgcgtgccgaggacaccgcggtatattactgtgcgaaacagggtacgccggttgatgggtttgactactggggtcagggaaccctggtcaccgtctcgagc

SEQ ID NO: 790 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctgatgagggtatgacgtgggtccgccaggctccagggaagggtctagagtgggtctcaacgattgagactggtggtacggtgacatactacgcagactccgtgaagggccggttcaccatctcccgcgacaattccaagaacacgctgtatctgcaaatgaacagcctgcgtgccgaggacaccgcggtatattactgtgcgaaaatggatgggtctggtacatggcagacgtttgactactggggtcagggaaccctggtcaccgtctcgagc

SEQ ID NO: 791 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatagtctgggtatgggttgggcccgccaggctccagggaagggtctagagtgggtctcatatattcgggctgagggtgcttatacatactacgcagactccgtgaagggccggttcaccatctcccgcgacaattccaagaacacgctgtatctgcaaatgaacagcctgcgtgccgaggataccgcggtatattactgtgcgaaatatcttgcggattctgactactggggtcagggaaccctggtcaccgtctcgagc

SEQ ID NO: 792 - DNA, 360 bp, Artificial Sequence
  Description of Artificial Sequence: Synthetic polynucleotide
gaggtgcagctgttggaatctgggggaggcttggtacagcctggggggtccctgcgtctctcctgtgcagcctccggattcacctttagtgagtcgtatatggagtgggtccgccaggctccagggaagggtctagagtgggtctcaggtattgatcatattggtggtgggacatactacgcagactccgtgaagggccggttcaccatctcccgcgacaattccaagaacacgctgtatctgcaaatgaacagcctgcgtgccgaggacaccgcggtatattactgtgcgaaagatgatggtcgtggtgggtctatgtttgactactggggtcagggaaccctggtcaccgtctcgagc

SEQ ID NO: 793 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttctggtgggtatatgtggtgggtccgccaggctccagggaagggtctagagtgggtctcaagtattggggctagtggtgcgtatacatactacgcagactccgtgaagggccggttcaccatctcccgcgacaattccaagaacacgctgtatctgcaaatgaacagcctgcgtgccgaggacaccgcggtatattactgtgcgaaaacggggggtaggttagactactggggtcagggaaccctggtcaccgtctcgagc

SEQ ID NO: 794 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgaggggcatatggggtgggtccgccaggctccagggaaggatctagagtgggtctcatatattgggagtctgggtttgcatacatactacgcagactccgtgaagggccggttcaccatctcccgcgacaattccaagaacacgctgtatctgcaaatgaacagcctgcgtgccgaggacaccgcggtatattactgtgcgaaacgggagtttagtaatggggggtttgactactggggtcagggaaccctggtcaccgtctcgagc

SEQ ID NO: 795 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagactagtcctatgtattgggtccgccaggctccagggaagggtctagagtgggtctcatcgattgatcggactggtgggcatacatactacgcagactccgtgaagggccggttcaccatctcccgcgacaattccaagaacacgctgtatctgcaaatgaacagcctgcgtgccgaggacaccgcggtatattactgtgcgaaacaggctctgcttactgatgcgaagcgttttgactactggggtcagggaaccctggtcaccgtctcgagc

SEQ ID NO: 796 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatggtcgggatatggtttgggtccgccaggctccagggaagggtctagagtgggtctcagctattagtccgagtggtctggatacatactacgcagactccgtgaagggccggttcaccatctcccgcgacaattccaagaacacgctgtatctgcaaatgaacagcctgcgtgccgaggacaccgcggtatattactgtgcggaacgtcctcagatgctggttactaattttgactactggggtcagggaaccctggtcaccgtctcgagc

SEQ ID NO: 797 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaatgatccgatgagttgggtccgccaggctccagggaagggtctagagtgggtctcagggattggtcgggagggtgattctacatactacgcagactccgtgaagggccggttcaccatctcccgcgacaattccaagaacacgctgtatctgcaaatgaacagcctgcgtgccgaggacaccgcggtatattactgtgcgaaagattctatgcggcatcagccgtttgactactggggtcagggaaccctggtcaccgtctcgagc

SEQ ID NO: 798 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgagacttatatgaagtgggtccgccaggctccagggaagggtctagagtgggtctcagcgattggggcgtcgggtgctgatacatactacgcagactccgtgaagggccggttcaccatctcccgcgacaattccaagaacacgctgtatctgcaaatgaacagcctgcgtgccgaggacaccgcggtatattactgtgcgaaatttacgcatctgaatggtcggtttgactactggggtcagggaaccctggtcaccgtctcgagc

SEQ ID NO: 799 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggggggtggcctatggggtgggtccgccaggctccagggaagggtctagagtgggtctcaggtattgatattgatggtgctccgacatactacgcagactccgtgaagggccggttcaccatctcccgcgacaattccaagaacacgctgtatctgcaaatgaacagcctgcgtgccgaggacaccgcggtatattactgtgcgaaagaggaggcgggttcttggtcttttgactactggggtcagggaaccctggtcaccgtctcgagc

SEQ ID NO: 800 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgatcaggcgatgtggtgggcccgccaggctccagggaagggtctagagtgggtctcatttattcagggtgatggtggttttacatactacgcagactccgtgaagggccggttcaccatctcccgcgacaattccaagaacacgctgtatctgcaaatgaacagcctgcgtgccgaggacaccgcggtatattactgtgcgaaacctagtaagccgtttgactactggggtcagggaaccctggtcaccgtctcgagc

SEQ ID NO: 801 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagactggtcagatgggttgggcccgccaggctccagggaagggtctagagtgggtctcaaatattgatgggtctggtacgtatacatactacgcagactccgtgaagggccggttcaccatctcccgcgacaattccaagaacacgctgtatctgcaaatgaacagcctgcgtgccgaggacaccgcggtatattactgtgcgaaagcggtgcggaattttgcttttgactactggggtcagggaaccctggtcaccgtctcgagc

SEQ ID NO: 802 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgggcatgatatgtcttgggtccgccaggctccagggaagggtctagagtgggtctcagctattagtcctcatggtacgcatacatactacgcagactccgtgaagggccggttcaccatctcccgcgacaattccaagaacacgctgtatctgcaaatgaacagcctgcgtgccgaggacaccgcggtatattactgtgcgaaagggattaggggttggattggtcatgatacgcagccttttgactactggggtcagggaaccctggtcaccgtctcgagc

SEQ ID NO: 803 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagagtaaggatatgctttgggtccgccaggctccagggaagggtctagagtgggtctcatctatttcgtcggatggtactcatacatactacgcagactccgtgaagggccggttcaccatctcccgcgacaattccaagaacacgctgtatctgcaaatgaacagcctgcgtgccgaggacaccgcggtatattactgtgcgcaagagctgggtgggtcttggcagtttgactactggggtcagggaaccctggtcaccgtctcgagc

SEQ ID NO: 804 - DNA, 366 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcggatcgtgatatggtttgggtccgccaggctccagggaagggtctagagtgggtctcaggtattggggcgtcgggtacgtctacatactacgcagactccgtgaagggccggttcaccatctcccgcgacaattccaagaacacgctgtatctgcaaatgaacagcctgcgtgccgaggacgccgcggtatattactgtgcgaaaggtgggacgggtcctactgatttgtgggattttgactactggggtcagggaaccctggtcaccgtctcgagc

SEQ ID NO: 805 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgatgagaagatgctttgggtccgccaggctccagggaagggtctagagtgggtctcaagtattagtgtgagtggtctgcatacatactacgcagactccgtgaagggccggttcaccatctcccgcgacaattccaagaacacgctgtatctgcaaatgaacagcctgcgtgccgaggacaccgcggtatattactgtgcgaaagaggaggcgggttcttggtcttttgactactggggtcagggaaccctggtcaccgtctcgagc

SEQ ID NO: 806 - DNA, 357 bp, Artificial Sequence
  Description of Artificial Sequence: Synthetic polynucleotide
gaggtgcagctgttggagtccgggggaggcttggtacagcctggggggtccctgcgtctctcctgtgcagcctccggattcacctttgggcaggagaggatgatttgggtccgccaggctcctgggaagggtctagagtgggtctcagatatttcggcttcgggtgggactacatactacgcagactccgtgaagggccggttcaccatctcccgcgacaattccaagaacacgctgtatctgcaaatgaacagcctgcgtgccgaggacaccgcggtatattactgtgcgaaagaggaggcgggttcttggtcttttgactactggggtcagggaaccctggtcaccgtctcgagc

SEQ ID NO: 807 - DNA, 348 bp, Artificial Sequence
  Description of Artificial Sequence: Synthetic polynucleotide
gaggtgcagctgttggagtctgggggaggcttggtacagcctggggggtctctgcgtctctcctgtgcagcctccggattcacctttgagtggtatgagatgcagtgggtccgccaggctccagggaagggtctagagtgggtctcagcgatttctggtgatggttatcgtacatactacgcagactccgtgaaaggccggttcaccatctcccgcgacaattccatgaacacgctgtatctgcaaatgaacagcctgcgtgccgaggacaccgcggtatattactgtgcgaaagagcttgggtattttgactacaggggtcggggaaccctggtcaccgtctcgagc

SEQ ID NO: 808 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactactggggtcggggaaccctggtcaccgtctcgagc

SEQ ID NO: 809 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggtctagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactaccgggttcagggaaccctggtcaccgtctcgagc

SEQ ID NO: 810 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgcaaggctccagggaagggtctagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactactggggtcggggaaccctggtcaccgtctcgagc

SEQ ID NO: 811 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccaggctccagggaagggtctagagtggatctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactacagggttcagggaaccctggtcaccgtctcgagc

SEQ ID NO: 812 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggtctagagtgggtctcagcgatttctggtgatggttatcgtacatactacgcagactccgtgaaaggccggttcaccatctcccgcgacaattccgagaacacgctgtatctgcaaatgaacagcctgcgtgccgaggacaccgcggtatattactgtgcgaaagagcttgggtattttgactactggggtcggggaaccctggtcaccgtctcgagc

SEQ ID NO: 813 - DNA, 348 bp, Artificial Sequence
  Description of Artificial Sequence: Synthetic polynucleotide
gaggtgcagctgttggagactgggggaggcttggtacagcctggggggtccctgcgtctctcctgtgcagcctccggattcacctttgagtggtatgagatgcagtgggtccgccgggctccagggaagggtctagagtgggtctcagcgatttctggtgatggttatcgtacatactacgcagactccgtgaaaggccggttcaccatctcccgcgacaattccaagaacacgctgtatctgcaaatggacagcctgcgtgccgaggacaccgcggtatattactgtgcgaaagagcttgggtattttgactactggggtcggggaaccctggtcaccgtcacgagc

SEQ ID NO: 814 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccaggctccagggaagggtctagagtgggtctcagcgatttctggtgatggttatcgtacatactacgcagactccgtgaaaggccggttcaccatctcacgcgacaattccaagaacacgctgtatctgcaaatgaacagcctgcgtgccgaggacaccgcggtatattactgtgcgaaagagcttgggtattttcactactggggtcggggaaccctggtcaccgtctcgagc

SEQ ID NO: 815 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgtagcctccggattcacctttgagtggtatgagatgcagtgggtccgccaggctccagggaatggtctagagtggatctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactactggggtcggggaaccctggtcaccgtctcgagc

SEQ ID NO: 816 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctctggattcacctttgagtggtatgagatgcagtgggtccgccgggctccagggaagggtctagagtgggtctcagcgatatctggtgatggttatcgtacatactacgcagactccgtgaaaggccggttcaccatctcccgcgacaattccaagaacacgctgtatctgctaatgaacagcctgcgtgccgaggacaccgcggtatattactgtgcgaaagagcttgggtatttcgactactggggtcggggaaccctcgtcaccgtctcgagc

SEQ ID NO: 817 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgcaaggctccagggaagggtctagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactacaggggtcggggaaccctggtcaccgtctcgagc

SEQ ID NO: 818 - DNA, 348 bp, Artificial Sequence
  Description of Artificial Sequence: Synthetic polynucleotide
gaggtgcagctgttggagtctgggggaggcttggtacagcctggggggtccatgcgtctctcctgtgcagcctccggattcacctttgagtggtatgagatgcagtgggtccgccgggctccagggaagggtctagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactacaggggtcggggaaccctggtcaccgtctcgagc

SEQ ID NO: 819 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggattagagtgggtctcaatgatttccggggatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactactggggtcggggaaccctggtcaccgtctcgagc

SEQ ID NO: 820 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgacggttggcgcacatactacgcagactccgtgaaaggccggttcaccatctcccgcgacaattccaagaacacgctgtatctgcaaatgaacagcctgcgtgccgaggacaccgcggtatattactgtgcgaaagagcttgggtattttgactactggggtcggggaaccctggtcaccgtctcgagc

SEQ ID NO: 821 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagctgctctactttgactactggggtcggggaaccctggtcaccgtctcgagc

SEQ ID NO: 822 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagctggggttctttgactactggggtcggggaaccctggtcaccgtctcgagc

SEQ ID NO: 823 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagttggagtattttgactactggggtcggggaaccctggtcaccgtctcgagc

SEQ ID NO: 824 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggataccgcggtatattactgtgcgaaagggttggagtattttgactactggggtcggggaaccctggtcaccgtctcgagc

SEQ ID NO: 825 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagctggccttctttgactactggggtcggggaaccctggtcaccgtctcgagc

SEQ ID NO: 826 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagctcttgtactttgactactggggtcggggaaccctggtcaccgtctcgagc

SEQ ID NO: 827 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagttggagttctttgactactggggtcggggaaccctggtcaccgtctcgagc

SEQ ID NO: 828 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagctgcagttctttgactactggggtcggggaaccctggtcaccgtctcgagc

SEQ ID NO: 829 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggataccgcggtatattactgtgcgaaagagctgctcttctttgactactggggtcggggaaccctggtcaccgtctcgagc

SEQ ID NO: 830 - DNA, 348 bp, Artificial Sequence
  Description of Artificial Sequence: Synthetic polynucleotide
gaggtgcagctgttggagtctgggggaggcttggtacggcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggataccgcggtatattactgtgcgaaagagttggagttctttgactactggggtcggggaaccctggtcaccgtctcgagc

SEQ ID NO: 831 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagttgctcttctttgactaccggggtcggggaaccctggtcaccgtctcgagc

SEQ ID NO: 832 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcatctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggataccgcggtatattactgtgcgaaaaacttggagtattttgactactggggtcggggaaccctggtcaccgtctcgagc

SEQ ID NO: 833 - DNA, 348 bp, Artificial Sequence
  Description of Artificial Sequence: Synthetic polynucleotide
gaggtgcggctgttggagtctgggggaggcttggtacagcctggggggtccctgcgtctctcctgtgcagcctccggattcacctttgagtggtatgagatgcagtgggtccgccgggctccagggaagggactagagtgggtctcagcgatttctggtgatggttatcgtacatactacgcagactccgtgaaaggccggttcaccatctcccgcgacaattccaagaacacgctgtatctgcaaatgaacagcctgcgtgccgaggacaccgcggtatattactgtgcgaaagagttgcagttctttgactactggggtcggggaaccctggtcaccgtctcgagc

SEQ ID NO: 834 - DNA, 348 bp, Artificial Sequence
  Description of Artificial Sequence: Synthetic polynucleotide
gaggtgcagctgttggggtctgggggaggcttggtacagcctggggggtccctgcgtctctcctgtgcagcctccggattcacctttgaggaggaggagatgatttgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgttcgaaagagccgtttcgttttgactactggggtcagggaaccctggtcaccgtctcgagc

SEQ ID NO: 835 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 836 - DNA, 348 bp, Artificial Sequence
  Description of Artificial Sequence: Synthetic polynucleotide
gaggtgcagctgttggcgtctgggggaggcttggtacagcctggggggtccctgcgtctctcctgtgcagcctccggattcacctttgaggaggaggagatgatttgggtccgccaggctccagggaagggtctagagtggatctcagctattagtggaagtggtggtagcacatactacgcagactccgtgaagggccggtttaccatctcccgcgacaattccaagaacacgctgtatctgcaaatgaacagcctgcgtgccgaggataccgcggtatattactgtgggaaagagccgtttcgttttgactactggggtcagggaaccctggtcaccgtctcgagc

SEQ ID NO: 837 - DNA, 348 bp, Artificial Sequence
  Description of Artificial Sequence: Synthetic polynucleotide
gaggtgcagctgttggatcctgggggaggcttggtacagcctggggggtccctgcgtctctcctgtgcagcctccggattcacctttgggaaggaggagatgatttgggtccgccaggctccagggaagggtctagagtgggtctcatctattagtggtagtggtggtagcacatactacgcagactccgtgaagggccggttcaccatctcccgcgacaattccaggaacacgctgtatctgcaaatgaacagcctgcgtgccgaggataccgcggtatattactgtgggaaagagccgtttcgttttgactactggggtcagggaaccctggtcaccgtctcgagc

SEQ ID NO: 838 - DNA, 348 bp, Artificial Sequence
  Description of Artificial Sequence: Synthetic polynucleotide
gaggtgcagctgttggggtctgggggaggcttggtacagcctggggggtccctgcgtctctcctgtgcagcctccggattcacctttgaggaggaggagatgatttgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgtttcgttttgactactggggtcagggaaccctggtcaccgtctcgagc

SEQ ID NO: 839 - DNA, 348 bp, Artificial Sequence
  Description of Artificial Sequence: Synthetic polynucleotide
gaggtgcagctgttggagcctgggggaggcttggtacagcctgggggctccctgcgtctctcctgtgcagcctccggattcacctttgaggaggaggagatgatttgggtccgccaggctccagggaagggtctagagtgggtctcagctattagtggtagtggtggtagcacatactacgcagactccgtgaagggccggttcaccatctcccgcgacaattccaagaacacgctgtatctgctaatgaacagcctgcgtgccgaggataccgcggtatattactgttcgaaagagccgtttcgttttgactactggggtcagggagccctggtcaccgtctcgagc

SEQ ID NO: 840 - DNA, 348 bp, Artificial Sequence
  Description of Artificial Sequence: Synthetic polynucleotide
gaggtgcagctgttggatcctgggggaggcttggtacagcctggggggtccctgcgtctctcctgtgcagcctccggattcacctttgggaaggaggagatgatttgggtccgccaggctccagggaagggtctagagtgggtctcatctattagtggtagtggtggtagcacatactacgcagactccgttaagggccggttcaccatctcccgcgacaattccaagaacacgctgtatctgcaaatgaacagcctgcgtgccgaggataccgcggtatattactgtgcgaaagagccgttacgttttgactactggggtcagggaaccctggtcaccgtctcgagc

SEQ ID NO: 841 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggaggaggagatgatctgggtccgccaggctcctgggaagggtctagagtggatctcagctattagtggtagtggtggtagcacatactacgcagactccgtgaagggccggttcaccatccaccgcgacaattctaagaacactctgtatctgcaaatgaacagcctgcgtgccgaggataccgcggtatattactgttcgaaagagccgtttcgttttgactacaggggtctgggaaccttggtcaccgtctcgagc

SEQ ID NO: 842 - DNA, 348 bp, Artificial Sequence
  Description of Artificial Sequence: Synthetic polynucleotide
gaggtgcagctgttggatcctgggggaggcttggtacagcctggggggtccctgcgtctctcctgtgcagcctccggattcacctttgggaaggaggagatgatttgggtccgccaggctccagggaagggtctagagtgggtctcatctattagtggtagtggtggtagcacatactacgcagactccgtgaagggccggttcaccatctcccgcgacaattccaggaacacgctgtatctgcaaatgaacagcctgcgtgccgaggataccgcggtatattactgtgcgaaagagccgttacgttttgactactggggtcaggggaccctggtcaccgtctcgagc

SEQ ID NO: 843 - DNA, 348 bp, Artificial Sequence
  Description of Artificial Sequence: Synthetic polynucleotide
gaggtgcagctgttggattctgggggaggctttgtacagcctggggggtccctgcgtctctcctgtgcagcctccggattcacctttgaggaggaggagatgatttgggtccgccaggctccagggaagggtctagagtggatctcagctattagtggtagtggtggtagcacatactacgcagactccgtgaagggccggttcaccatctcccgcgacaattccaagaacacgctgtatctgcaaatgaacagcctgcgtgccgaggataccgcggtgtattactgtgcgaaagagccgtttcgttttgactactggggtcagggaaccctggtcaccgtctcgagc

SEQ ID NO: 844 - DNA, 348 bp, Artificial Sequence
  Description of Artificial Sequence: Synthetic polynucleotide
gaggtgcagctgttggatcctgggggaggcttggtacagcctggggggtccctgcgtctctcctgtgcagcctccggattcacctttgaggaggaggagatgatttgggtccgccaggctccagggaagggtctagagtggatctcagctattagtggtagtggtggtagcacatactacgcagactccgtgaagggccggttcaccatctcccgcgacaattccaataacacgctgtatctgcaaatgaacagcctgcgtgccgaggataccgcggtatattactgtgggagagagccgtttcgttttgactactggggtcagggaaccctggtcaccgtctcgagc

SEQ ID NO: 845 - DNA, 348 bp, Artificial Sequence
  Description of Artificial Sequence: Synthetic polynucleotide
gaggtgcggctgttggagtctggggaaggcttggtacagcctggggggtccctgcgtctctcctgtgcagcctccggattcacctttgaggaggaggagatgatttgggtccgccaggctccagggaagggtctagagtgggtctcagctattagtggtagtggtggtagcacatactacgcagactccgtgaagggccggttcaccatctcacgcgacaattccaagaacacgctgtatctgcaaatgaacagcctgcgtgccgaggataccgcggtatattactgtgggaaagagccgtttcgttttgactactggggtcagggaaccctggtcaccgtctcgagc

SEQ ID NO: 846 - DNA, 348 bp, Artificial Sequence
  Description of Artificial Sequence: Synthetic polynucleotide
gaggtgcagcagttggagtctgggggaggcctggtacagcctggggggtccctgcgtctctcctgtgcagcctccggattcacctttgaggaggaggagatgatttgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgtttcgttttgactactggggtcagggaaccctggtcaccgtctcgagc

SEQ ID NO: 847 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgttctactacgactactggggtcagggaaccctggtcaccgtctcgagc

SEQ ID NO: 848 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgttctacttcgactactggggtcagggaaccctggtcaccgtctcgagc

SEQ ID NO: 849 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggagaaggagatgatttgggtccgtcaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgttcttctacgactactggggtcagggaaccctggtcaccgtctcgagc

SEQ ID NO: 850 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttccccaggaggagatgatttgggtccgtcaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 851 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttttcgccgccgagatgatttgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 852 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggcccggtacgagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 853 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcggatgggtttcagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 854 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcggtggggtcacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 855 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcgcctcggttggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 856 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtcgctggggtgccagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 857 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtaggcagggtgggagcacatactacgcagactccgtgaagggccggttcaccatctcccgtgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 858 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtgtgtccggttggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 859 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcggtggggttggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 860 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcggaacggtctgagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 861 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtgggctgggttggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 862 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtgcgttgggttggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 863 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcgcaggggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 864 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtaggcacggttggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 865 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcaagcattagcaggagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 866 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcggatcggtaacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 867 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtgggcacggttggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 868 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctatttcgaggtggggtggtagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 869 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgttcatgtatgactactggggtcagggaaccctggtcaccgtctcgagc

SEQ ID NO: 870 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgttcccgtacgactactggggtcagggaaccctggtcaccgtctcgagc

SEQ ID NO: 871 - DNA, 348 bp, Artificial Sequence
  Description of Artificial Sequence: Synthetic polynucleotide
gaggtgcagctgttggcgtctgggggaggcttggtgcagcctggggggtccctgcgtctctcctgcgcagcctccggattcacctttgaggaggaggagatgatttgggtccgtcaggctccagggaagggtctagagtgggtctcagctattagtggtagtggtggtggcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 872 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagccgttgtactatgactactggggtcagggaaccctggtcaccgtctcgagc

SEQ ID NO: 873 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgtcaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgggaaagagcccatgtactatgactactggggtcagggaaccctggtcaccgtctcgagc

SEQ ID NO: 874 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggtttcagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 875 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcgcacgggtgggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 876 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcgggagggtgggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 877 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccgggttcccctttgaggaggaggagatgatttgggtccgccaggctccagggaagggtctagagtgggtctcagctattagtcggcagggttggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 878 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggggcggtgggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 879 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcgcacgggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 880 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggtaggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 881 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 882 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggaagggtagcagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 883 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcggggcggttggagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 884 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtcgctcgggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 885 - DNA, 348 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggtatgagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 886 - DNA, 348 bp, Artificial Sequence
  Description of Artificial Sequence: Synthetic polynucleotide
gaggtgcagctgttggagtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 887 - DNA, 348 bp, Artificial Sequence
  Description of Artificial Sequence: Synthetic polynucleotide
gaggtgcagctgttggagtctggggaaggcttggtacagcctggggggtccctgcgtctctcctgtgcagcctccggattcacctttactgagcatgagatgatttgggtccgccaggctccagggaagggtctggagtgggtctcatctatttcgggtaatggtgctaatacatactacgcagactccgtgaagggccggttcaccatctcccgcgacaattccaagaacacgctgtatctgcaaatgaacagcctgcgtcccgaggacaccgcggtatattactgtgcgaaagagccgcttaggtttgactactggggccagggaaccctggtcaccgtctcgagc

SEQ ID NO: 888 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggatccacctttactgagtatgagatgatttgggtccgccaggctccagggaagggtctggagtggatctcatctatttcgggtaatggtgctaatacatactacgcagactccgtgaagggccggttcaccatctcccgcgacaattccaagaacacgctgtatctgcaaatgaacagcctgcgtgccgaggacaccgcggtatatttctgtgcgaaagagccgcttaggtttgactacaggggtcagggaaccctggtcaccgtctcgagc

SEQ ID NO: 889 - DNA, 348 bp, Artificial Sequence
  Description of Artificial Sequence: Synthetic polynucleotide
gaggtgcagctgttggagcctgggggaggcttggtacagcctggggggtccctgcgtctctcctgtgcagcctccggattcacctttactgagtatgagatgatttgggtccgcaaggctccagggaagggtatggagtgggtctcatctatttcgggtaatggtgctaatacatactacgcagactccgtgaagggccggttcaccatctcccgcgacaattccaagaacatgctgtatctgcaaatgaacagcctgcgtgccgaggacaccgcggtatattactgtgcgaaagagccgcttaggtttggctactggggtcagggtaccctggtcaccgtctcgagc

SEQ ID NO: 890 - DNA, 348 bp, Artificial Sequence
  Description of Artificial Sequence: Synthetic polynucleotide
gaggtgcagctgttggattctgggggaggcttggtacagcctggggggtcactgcgtctctcctgtgcagcctccggattcacctttactgagtatgagatgatttgggtccgccaggctccagggaagggtctggagtgggtctcatctatttcgggtaatggtgctaatacatactacgcagactccgtgaagggccggttcaccatctcccgcgacaattccaagaacacgctgtatctacaaatgaacagcctgcgtgccgaggacaccgcggtatattactgtgcgaaagagccgcttaggtttgactactggggtcggggaaccctggtcaccgtctcgagc

SEQ ID NO: 891 - DNA, 348 bp, Artificial Sequence
  Description of Artificial Sequence: Synthetic polynucleotide
gaggtgcagctgttggggtcagggggaggcttggtacagcctggggggtccctgcgtctctcctgtgcagcctccggattcacctttactgagtatgagatgatttgggtccgccaggctccagggaagagtctggagtgggtctcatctatttcgggtaatggtgctaatacatactacgcagactccgtgaagggccggttcaccatctcccgcgacaattccaagaacacgctgtatctgcaaatgaacagcctgcgtgccgaggacaccgcggtatattactgtgcgaaagagccgcttaggtatgacgactggggtcagggaaccctggtcaccgtctcgagc

SEQ ID NO: 892 - DNA, 348 bp, Artificial Sequence
  Description of Artificial Sequence: Synthetic polynucleotide
gaggtgcagccgttggagtctgggggaggcttggtacagcctggggggtccctgcgtctctcctgttcagcctccggattcacctttaatgagtatgagatgatttgggtccgccaggctccagggaagggtctggagtgggtctcatctatttcgggtaatggtgctaatacatactacgcagactccgtgaagggccggttcaccatctcccgcgacaattccaagaacacgctgtatctgcaaatgaacagcctgcgtgccgaggacaccgcggtatattactgtgcgaaagagccgcttaggtttgactactggggtcagggaaccctggtcaccgtctcgagc

SEQ ID NO: 893 - DNA, 348 bp, Artificial Sequence
  Description of Artificial Sequence: Synthetic polynucleotide
gaggtgcagctgttggagtctggggaaggcttggtacagcctggggggtccctgcgtctctcctgtgcagcctccggattcacctttgctgagtatgagatgatttgggtccgccaggctccagggaaaggtctggagtgggtctcatctatttcgggtaatggtgctaatacatactacgcagactccgtgaagggccggttcaccatctcccgcgacaattccaagaacacgctgtatctgcaaatgaacagcctgcgtgccgaggacaccgcggtatattactgtgcgaaagagccgcttaggtttgactactggggtcagggaaccctggtcaccgtctcgagc

SEQ ID NO: 894 - DNA, 348 bp, Artificial Sequence
  Description of Artificial Sequence: Synthetic polynucleotide
gaggtgcagctgttggaccctgggggaggcttggtacagcctggggggtccctgcgtctctcctgtgcagcctccggattcacctttactgagtctgagatgatttgggtccgccaggctccagggaagggtctggagtgggtctcatctatttcgggaaatggtgctaatacatactacgcggactccgtgaagggccggttcaccatctcccgcgacaattccaagaacacgctgtatctgcaaatgaacagcctgcgtgccgaggacaccgcggtatattactgtgcgaaagagccgcttaggtttgactactggggtcagggaaccctggtcaccgtctcgagc

SEQ ID NO: 895 - DNA, 348 bp, Artificial Sequence
  Description of Artificial Sequence: Synthetic polynucleotide
gaggtgcagctgttggagcctgggggaggcttggtacagcctggggggtccctgcgtctctcctgtgcagcctccggattcacctttactgagtatgagatgatttgggtccgcaaggctccagggaagggtatggagtgggtctcatctatttcgggtaatggtgctaatacatactacgcagactccgtgaagggccggttcaccatctcccgcgacaattccaagaacacgctgtatctgcaaatgaacagcctgcgtcccgaggacaccgcggtatattactgtgcgaaagagccgcttaggtttgacgactggggtcagggaaccctggtcaccgtctcgagc

SEQ ID NO: 896 - DNA, 348 bp, Artificial Sequence
  Description of Artificial Sequence: Synthetic polynucleotide
gaggtgcagctgttggagtctggggtaggcttggtacagcctggggggtccctgcgtctctcctgtgcagcctccggattcacctttactgagtatgagatgatttgggtccgcaaggccccagggaagggtctggagtgggtctcatctatttcgggtaatggtgctaatacatactacgcagactccgtgaagggccggttcaccatctcccgcgacaattccaagaacacgctgtatctgcaaatgaacagcctgcgtgccgaggacaccgcggtatattactgtgcgaaagaaccgcttaggtttgacaactggggtcagggaaccctggtcaccgtctcgagc

SEQ ID NO: 897 - DNA, 348 bp, Artificial Sequence
  Description of Artificial Sequence: Synthetic polynucleotide
gaggtgcagttgttggagtctcggggaggcttggtacagcctggggggtccctgcgtctctcctgtgcagcctccggattcacctttactgagcatgagatgatttgggtccgccaggctccagggaagggtctggagtgggtctcatctatttcgggtaatggtgctaatacatactacgcagactccgtgaagggccggttctccgtctcccgcgacaattccaagaacacgctgtatctgcaaatgaacagcctgcgtgccgaggacaccgcggtatattactgtgcgaaagagccgcttaggtttgactactggggtcagggaaccctggtcaccgtctcgagc

SEQ ID NO: 898 - DNA, 348 bp, Artificial Sequence
  Description of Artificial Sequence: Synthetic polynucleotide
gaggtgcagccgttggagtctgggggaggcttggtacagcctggggggtccctgcgtctctcctgtgctgcctccggattcacctttactgagtatgagatgatttgggtccgccaggctccagggaagggtctggagtgggtctcatctatttcgggtaatggtgctaatacatactacgcagactccgtgaagggccggttcaccatctcccgcgacaattccaagaacacgctgtatctgcaaatgaacagcctgcgtgccgaggacaccgcggtatattactgtgcgaaagagccgcttaggtttgactactggggtcagggaaccctggtcaccgtctcgagc

SEQ ID NO: 899 - DNA, 348 bp, Artificial Sequence
  Description of Artificial Sequence: Synthetic polynucleotide
gaggtgcagctgttggagtctgcgggaggcttggtacagcctggggggtccctgcgtctctcctgtgcagcctccggattcacctttgctgagtatgagatgatttgggtccgccaggctccagggaagggtctggagtgggtctcatcaatttcgggtaatggtgctaatacatactacgcagactccgtgaagggccggttcaccatctcccgcgacaattccaagaacacgctgtatctgcaaatgaacagcctgcgtgccgaggacaccgcggtatattactgtgcgaaagagccgcttaggtttgactactggggtcagggagccctggtcaccgtctcgagc

SEQ ID NO: 900 - DNA, 348 bp, Artificial Sequence
  Description of Artificial Sequence: Synthetic polynucleotide
gaggtgcagctgttggagcctgggggaggcttggtacagcctggggggtcgctgcgtctctcctgtgcagcctccggattcacctttactgagtatgagatgatttgggtccgccaggctccagggaagggtctggagtgggtctcatctatttcgggtaatggtgctaatacatactacgcagactccgtgaagggccggttcaccatctcccgcgacaattccaagaacacgctgtatctgcaaatgaacagcctgcgtgccgaggacaccgcggtatattactgtgcgaaagagccgcttaggtttgacaactggggtcagggaaccctggtcaccgtctcgagc

SEQ ID NO: 901 - DNA, 369 bp, Artificial Sequence
  Description of Artificial Sequence: Synthetic polynucleotide
gaggtgcagctgttggagtctgggggaggcttggtacagcctggggggtctctgcgtctctcctgtacagcctccggattcacctttaatatgtatgagatgtcgtgggtccgccaggctccagggaagggtctagagtgggtctcaggtattagtagacgtggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgatttgaggtatgcgcgttttgactactcgggtcagggaaccctggtcaccgtctcgagc

SEQ ID NO: 902 - DNA, 369 bp, Artificial Sequence
  Description of Artificial Sequence: Synthetic polynucleotide
gaggagcagctgttggagtctgggggaggcttggtacagcctggggggtccctgcgtctctcctgtacagcctccggattcacctttaatatgtatgagatgtcgtgggtccgccaggctccagggaagggtctagagtgggtctcaggtattagtagacgtggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgctacgaggtatgcgcgttttgactactggggtcagggaaccctggtcaccgtctcgagc

SEQ ID NO: 903 - DNA, 369 bp, Artificial Sequence
  Description of Artificial Sequence: Synthetic polynucleotide
gaggtgcagctgttggagtctgggggaggcttggtacagcctggggggtccctgcgtctctcctgtacagcctccggattcacctttaatatgtatgagatgtcgtgggtccgccaggctccagggaagggtctagagtgggtctcaggtattagtaggcgtggttttactacatactacgcagactccgtgaagggccggttcaccatctcccgcgacaatttcaagaacacgctgtatctgcaaatgaacagcctgcgtgccgaggataccgcggtatattactgtgcgaaagagccgattacgtatgatatgaggtatgcgcgttttgactacgggggtcagggaaccctggtcaccgtctcgagc

SEQ ID NO: 904 - DNA, 369 bp, Artificial Sequence
  Description of Artificial Sequence: Synthetic polynucleotide
gaggtgcagctgttggagtctgggggaggcttggtacagcctggggggtccctgcgtctctcctgtacagcctccggattcacctttaatatgtatgagatgtcgtgggtccgccaggctccagggaagggtctagagtgggtctcaggtattagtaggcgtggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgatatgaggtatgcgcgttttgacaactggggtcagggaaccctggtcaccgtctcgaac

SEQ ID NO: 905 - DNA, 369 bp, Artificial Sequence
  Description of Artificial Sequence: Synthetic polynucleotide
gaggtgcagctgttggagtctgggggaggcttggtacagcctggggggtccctgcgtctctcctgtacagcctccggattcacctttaatacgtatgagatgtcgtgggtccgccaggctccagggaagggtctagagtgggtctcaggtattggtaggcgtggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgatttgaggtatgcgcgttttgactactcgggtcagggaaccctggtcaccgtctcgagc

SEQ ID NO: 906 - DNA, 369 bp, Artificial Sequence
  Description of Artificial Sequence: Synthetic polynucleotide
gaggtgcagctgatggagtcagggggaggcttggtacagcctggggggtccctgcgtctctcctgtacagcctccggattctcctttaatatgtatgagatgtcgtgggtccgccaggctccagggaaaggtctagagtgggtctcaggtattagtaggcgtggttatactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgatatgaggtatgcgcgttttgactactggggtcggggaaccctggtcaccgtctcgagc

SEQ ID NO: 907 - DNA, 369 bp, Artificial Sequence
  Description of Artificial Sequence: Synthetic polynucleotide
gaggtgcagctgttggagtctgggggaggcttggtgcagcctggggggtccctgcgtctctcctgtacagcctccggattcgcctttaatatgtatgagatgtcgtgggtccgccaggctccagggaagggactagagtgggtctcaggtattagtaggcatggttttactacgtactacgcagactccgtgaagggccggttcaccgtctcccgcgacaattccaagaacacgctgtatctgcaaatgaacagcctgcgtgccgaggataccgcggtatattactgtgcgaaagagccgattacgtatgatatgcggtatgcgcgttctgactactggggtcagggaaccctggtcaccgtctcgagc

SEQ ID NO: 908 - DNA, 369 bp, Artificial Sequence
  Description of Artificial Sequence: Synthetic polynucleotide
gaggtgcagctgttggagtctgggggaggcttggtacagcctggggggtccctgcgtctctcctgtacagcctccggattcacctttaatatgtatgagatgtcgtgggtccgccaggctccagggaagggtctagagtgggtctcaggtattagtaggcgtggttttactacatactacgcagactccgtgaagggccggttcaccatctcccgcgacaattccaagaacacgctgtatctgcaaatgaacagcctgcgtgccgaggataccgcggtatatttctgtgcgaaagagccgattacgtatgatatgaggtatgcgcgttctgactactggggtcagggaaccctggtcaccgtctcgagc

SEQ ID NO: 909 - DNA, 369 bp, Artificial Sequence
  Description of Artificial Sequence: Synthetic polynucleotide
gaggtgcagctgttggagtctggggggggcttggttcagcctggggggtccctgcgtctctcctgtacagcctccgggttcacctttaatatgtatgagatgtcgtgggtccgccaggctccagggaagggtctagagtgggtctcaggtattagtaggcgtggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtattctatgaggtatgcgcgttttgactactcgggtctgggaaccatggtcaccgtctcgagc

SEQ ID NO: 910 - DNA, 369 bp, Artificial Sequence
  Description of Artificial Sequence: Synthetic polynucleotide
gaggtgcagctgctggagtctgggggaggcttggtacagcctggggggtcccttcgtctctcctgtacagcctccggattcacctttaatatgtatgagatgtcgtgggtccgccaggctccagggaagggtctagagtgggtctcaggtattagtaggcgtggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgatatgaggtatgcgcgttttgactacagtggtcagggaaccctggtcaccgtctcgagc

SEQ ID NO: 911 - DNA, 369 bp, Artificial Sequence
  Description of Artificial Sequence: Synthetic polynucleotide
gaggtgcagctgttggagtctggaggaggcttggtacagcctggggggtccctgcgtctctcctgtacagcctccggattcacctttaatatgtatgagatgtcgtgggtccgcaaggctccagggaagggtctagagtgggtctcaggtattagtaggcatggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgatatgaggtatgcgcgttttgactactggggtcagggaaccctggtcaccgtctcgagc

SEQ ID NO: 912 - DNA, 369 bp, Artificial Sequence
  Description of Artificial Sequence: Synthetic polynucleotide
gaggtgcagctgttcgagtctgggggaggcttggtacagcctggggggtccctgcgtctctcctgtacagcctccggattcacctttaatatgtatgagatgtcgtgggtccgccaggctccagggaagggtctagagtgggtctcaggtattagtaggcgtggttttactacatactacgcagactccgtgaagggccggttcaccatctcccgcgacaattccaagaacacgctgtatctgcaaatgaacagcctgcgtgccgaggataccgcggtatattactgtgcgaaggagccgattacgtatgatatgaggtatgcgcgttttgactactggggtcggggaaccctggtcaccgtctcgagc

SEQ ID NO: 913 - DNA, 369 bp, Artificial Sequence
  Description of Artificial Sequence: Synthetic polynucleotide
gaggtgcagctgttggagtctgggggaggcttggtacagcctgggggatccctgcgtctctcctgtacagcctccggtttcacctttaatatgtatgagatgtcgtgggtccgccaggctccagggaagggtctagagtgggtctcaggtattagtaggcgtggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgatatgaggtatgcgcgttttgactactggggtcggggaaccctggtcaccgtctcgagc

SEQ ID NO: 914 - DNA, 369 bp, Artificial Sequence
  Description of Artificial Sequence: Synthetic polynucleotide
gaggtgcagctgttggagtctgggggaggctcggtacagcctggggggtccctgcgtctctcctgtacagcctccggattctcctttaatatgtatgagatgtcgtgggtccgccaggctccagggaagggtctagagtgggtctcaggtattagtaggcgtggttttactacatactacgcagactccgtgaagggccggttcaccatctcccgcgacaattccaagaacacgctgtatctgcaaatgaacagcctgcgtgccgaggataccgcggtatattactgtgcgaaagagccgattacgtatgatatgaggtatgcgcgttttgactactggggtcagggaaccctggtcaccgtctcgggc

SEQ ID NO: 915 - DNA, 369 bp, Artificial Sequence
  Description of Artificial Sequence: Synthetic polynucleotide
gaggtgcagctgttggagtctgggggaggcttggtacaacctggggggtccctgcgtctctcctgtacagcctccggattcacctttaatatgtatgagatgtcgtgggtccgcaaggctccagggaagggtctagagtgggtctcaggtattagtaggcgtggttttactacatactacgcagactccgtgaagggccggttcaccatctcccgtgacaattccaagaacacgctgtatctgcaaatgaacagcctgcgtgccgaggataccgcggtatattactgtgcgaaagagccgattacgtatgatatgaggtatgcgcgttttgactactggggtcagggaaccctggtcaccgtctcgagc

SEQ ID NO: 916 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 917 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 918 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgcagaggataccgcggtatattactgtacgaaacttccgtttatttttgaatactggggtcagggaaccctggtcaccgtctcgagc

SEQ ID NO: 919 - DNA, 348 bp, Artificial Sequence
  Description of Artificial Sequence: Synthetic polynucleotide
gaggtgcagctgttggagtccgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtgcgaaacttccgtttatgtttgacgaccggggtcagggaaccctggtcaccgtctcgagc

SEQ ID NO: 920 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 921 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattctcctttcgggattatgagatgtggtggtaccgccaggctccagggaagggtctagagcgggtctcagctattaatccgcagggtacgcgtacatattacgcagactccgtgaagggccggttcaccatctcccgcgacaattccaagaacacgctgtatctgcaaatgaacagcctgcgtgccgaggataccgcggtatattactgtgcgaaacttccgtttatttttgacaaccggggtcagggaaccctggtcaccgtctcgagc

SEQ ID NO: 922 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggatacctcggtatatcactgtgcgaaacctccgtttatttttggcgactggggtccgggaaccctggtcaccgtctcgagc

SEQ ID NO: 923 - DNA, 348 bp, Artificial Sequence
  Description of Artificial Sequence: Synthetic polynucleotide
gaggtgcagctgttggagtctgggggaggcttggtacagcctggggggtcccggcgtctctcctgtgcagcctccggattcacctttcgggattatgagatgtggtgggtccgccaggctccggggaagggtctagagcgggtctcagctattaatccgcagggtacgcgtacatactacgcagactccgtgaagggccggttcacgatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 924 - DNA, 348 bp, Artificial Sequence
  Description of Artificial Sequence: Synthetic polynucleotide
gaggtgcagctgttggagtctgggggaggcttggtacagcctggggggtccctgcgtctatcctgtgcagcctccggattcacctttcgggattatgagatgtggtgggtccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggatactgcggtatattactgtgcgaaacttccgtttatgtttgacgaccggggtcagggaaccctggtcaccgtctcgagc

SEQ ID NO: 925 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaaggttctagagcgggtctcagctattaatccgcagggtacgcgtacatactacgcagactccgtgaagggccggttcaccatctcccgcgacaattccaagaacatgctgtatctgcaaatgaacagcctgcgtgccgaggatactgcggtatattactgtgcgaaacttccgtttatgtttgacgaccggggtcagggaaccctggtcaccgtctcgagc

SEQ ID NO: 926 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgagccgaggatactgcggtatattactgtgcgaaacttccgtttatgtttgacgaccggggtcagggaaccctggtcaccgtctcgagc

SEQ ID NO: 927 - DNA, 348 bp, Artificial Sequence
  Description of Artificial Sequence: Synthetic polynucleotide
gaggtgcagctgttggagtctgggggaggcttgatacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtttgaaacttccgtttattttcgactactggggtcagggaaccctggtcaccgtctcgagc

SEQ ID NO: 928 - DNA, 348 bp, Artificial Sequence
  Description of Artificial Sequence: Synthetic polynucleotide
gaggtgcagctgttggagtctgggggaggcttggtacagcctggggggtccctgcgtctatcctgtgcagcctccggattcacctttcgggattatgagatgtggtgggtccgccaggctccagggaagggtctagagcgggtctcagctattaacccgcagggtacgcgtacatactatgcagactccgtgaagggccggttcaccatctcccgcgacaattccaagaacacgctgtatctgcaaatgaacagcctgcgtgccgatgataccgcggtatatcactgtacgaaacttccgtttatttttgactactggggtcagggaaccctggtcaccgtctcgagc

SEQ ID NO: 929 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggatggttctagagcgggtctcagctattaatccgcagggtacgcgtacatactacgcagactccgtgaagggccggttcaccatctcccgcgacaattccaagaacacgctatatctgcaaatgaacagcctgcgtgccgaggataccgcggtatattactgtgcgaaacttccgtttttttttgactccaggggtcagggaaccctggtcaccgtctcgagc

SEQ ID NO: 930 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccgggctccagggaagggtctagagcgggtctcagctattaatccgcagggtacgcgtacatactacgcagactctgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 931 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggacaccgcggtatattactgtgcgaaacttccgtttacttttgaggactggggtcagggaaccctggtcaccgtctcgagc

SEQ ID NO: 932 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattctcctttcgggattatgagatgtggtggtaccgccaggctccagggaagggtctagagcgggtctcagctattaatccgcagggtacgcgtacatattacgcagactccgtgaagggccggttcaccatctcccgcgacaattccaagaacacgctgtatctgcaaatgaacagcctgcgtgccgaggacaccgcggtatattactgtgcgaaacttccgtttacttttgaggactggggtcagggaaccctggtcaccgtctcgagc

SEQ ID NO: 933 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaaggttctagagcgggtctcagctattaatccgcagggtacgcgtacatactacgcagactccgtgaagggccggttcaccatctcccgcgacaattccaagaacatgctgtatctgcaaatgaacagcctgcgtgccgaggacaccgcggtatattactgtgcgaaacttccgtttacttttgaggactggggtcagggaaccctggtcaccgtctcgagc

SEQ ID NO: 934 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatatcactgtgcgaaacttccgtttacttttgaggactggggtcagggaaccctggtcaccgtctcgagc

SEQ ID NO: 935 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtacgaaacttccgtttacttttgaggactggggtcagggaaccctggtcaccgtctcgagc

SEQ ID NO: 936 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtttgaaacttccgtttacttttgaggactggggtcagggaaccctggtcaccgtctcgagc

SEQ ID NO: 937 - DNA, 348 bp, Artificial Sequence
  Description of Artificial Sequence: Synthetic polynucleotide
gaggtgcagctgttggagtctgggggaggcttggtacagcctggggggtccctgcgtctatcctgtgcagcctccggattcacctttcgggattatgagatgtggtgggtccgccaggctccagggaagggtctagagcgggtctcagctattaacccgcagggtacgcgtacatactatgcagactccgtgaagggccggttcaccatctcccgcgacaattccaagaacacgctgtatctgcaaatgaacagcctgcgtgccgatgataccgcggtatatcactgtacgaaacttccgtttatttttgaatactggggtcagggaaccctggtcaccgtctcgagc

SEQ ID NO: 938 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggacaccgcggtatattactgtgcgaaagaaccttatagttttgactcctggggtcagggaaccctggtcaccgtctcgagc

SEQ ID NO: 939 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggataccgcggtatatcactgtgcgaaagaaccttatagttatgactactggggtcagggaaccctggtcaccgtctcgagc

SEQ ID NO: 940 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccgggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 941 - DNA, 348 bp, Artificial Sequence
  Description of Artificial Sequence: Synthetic polynucleotide
gaggtgcagctgttggagtctgggggaggcttggtacagcctggggggtccctgcgtctatcctgtgcagcctccggattcacctttcgggattatgagatgtggtgggtccgccgggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggatactgcggtatattactgtgcgaaacttccgtttatgtttgacgaccggggtcagggaaccctggtcaccgtctcgagc

SEQ ID NO: 942 - DNA, 348 bp, Artificial Sequence
  Description of Artificial Sequence: Synthetic polynucleotide
gaggtgcagctgttggagtctgggggaggcttggtacagcctggggggtccctgcgtctatcctgtgcagcctccggattcacctttcgggattatgagatgtggtgggtccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggatactgcggtatattactgtgcgaaacttccgtttatgtttgacgactggggtcagggaaccctggtcaccgtctcgagc

SEQ ID NO: 943 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagttgtggtgggtccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 944 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagttgtggtgggtccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggatactgcggtatattactgtgcgaaacttccgtttatgtttgacgaccggggtcagggaaccctggtcaccgtctcgagc

SEQ ID NO: 945 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtggttccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 946 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtggttccgccaggctccagggaagggtctagagcgggtctcagctattaatccgcagggtacgcgtacatactacgcagactccgtgatgggccggttcaccatctcccgcgacaattccaagaacacgctgtatctgcaaatgaacagcctgcgtgccgaggatactgcggtatattactgtgcgaaacttccgtttatgtttgacgaccggggtcagggaaccctggtcaccgtctcgagc

SEQ ID NO: 947 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagtgggtctcagctattaatccgcagggtacgcgtacatactacgcagactccgtgatgggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 948 - DNA, 348 bp, Artificial Sequence
  Description of Artificial Sequence: Synthetic polynucleotide
gaggtgcagctgttggagtctgggggaggcttggtacagcctggggggtccctgcgtctatcctgtgcagcctccggattcacctttcgggattatgagatgtggtgggtccgccaggctccagggaagggtctagagtgggtctcagctattaatccgcagggtacgcgtacatactacgcagactccgtgatgggccggttcaccatctcccgcgacaattccaagaacacgctgtatctgcaaatgaacagcctgcgtgccgaggatactgcggtatattactgtgcgaaacttccgtttatgtttgacgaccggggtcagggaaccctggtcaccgtctcgagc

SEQ ID NO: 949 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgacctacttttccgaccggggtcagggaaccctggtcaccgtctcgagc

SEQ ID NO: 950 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgtttttctttgaggagtggggtcagggaaccctggtcaccgtctcgagc

SEQ ID NO: 951 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgacgtactttaaggactggggtcagggaaccctggtcaccgtctcgagc

SEQ ID NO: 952 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttacttttccgagtggggtcagggaaccctggtcaccgtctcgagc

SEQ ID NO: 953 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatatcactgtgcgaaacttccgatgttctttgaggactggggtcagggaaccctggtcaccgtctcgaac

SEQ ID NO: 954 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgtttccgttttcggagtggggtcagggaaccctggtcaccgtctcgagc

SEQ ID NO: 955 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatggacagcctgcgtgccgaggacaccgcggtatattactgtgcgaaacttccgttttacttttccgagtggggtcagggaaccctggtcaccgtctcgagc

SEQ ID NO: 956 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtacggtaacctcacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 957 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcccggtaccttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggaccggggtcagggaaccctggtcaccgtctcgagc

SEQ ID NO: 958 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtggcttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 959 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgatgggtgggttcacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 960 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggttcgcacacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 961 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtccggtgggctgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgaccggggtcagggaaccctggtcaccgtctcgagc

SEQ ID NO: 962 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcacggttcgttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 963 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccggccggtcggttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 964 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtagcttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 965 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcccgactacgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatatcactgtgcgaaacttccgtttacttttgacgactggggtcagggaaccctggtcaccgtctcgagc

SEQ ID NO: 966 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagactccggattcacctttccgcccgtggagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 967 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtacggtgggctgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 968 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtaaccacacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 969 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcacggtggctacacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 970 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaggggtctagagcgggtctcagctattaatccgcccggtatgctcacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 971 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtcagttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 972 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtggctacacatactacgcagactccgtgaagggccgattcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 973 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtcgggtgggctgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 974 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtcgggtgggttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 975 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtcgggtacgctcacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 976 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtacggttcgttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 977 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtggctacacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 978 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtgggctgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 979 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggttcccacacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 980 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtaccttgacatactacgcagactccgtgaagggccggttcaccatctcccgcgacaattccaggaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 981 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgaacggtcggctgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgcggactggggtcagggaaccctggtcaccgtctcgagc

SEQ ID NO: 982 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtcagctgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 983 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcacggtggcctcacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 984 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctggagcgggtctcagctattaatccggcgggtatgttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 985 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcacggtaccttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 986 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggttcgttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 987 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtacggtggcctgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 988 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattacgagatgtggtgggtccgccaggctccagggaagggtctagagcgggtctcagctattaatccggccggtttcttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 989 - DNA, 348 bp, Artificial Sequence
  Description of Artificial Sequence: Synthetic polynucleotide
gaggtgcagctgttggagtctgggggaggcttggtacggcctggggggtccctgcgtctctcctgtgcagcctccggattcacctttcgggattatgagatgtggtgggtccgccaggctccagggaagggtctggagcgggtctcagctattaatccgtacggtggcctgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 990 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttcacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 991 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 992 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtacggtgggctgacatactacgcagactccgtgaagggccggttcaccatctcccgcgacaattccaagaacacgctgtatctgcaaatggacagcctgcgtgccgaggataccgcggtatattactgtgcgaaacttccgtttacttttgaggactggggtcagggaaccctggtcaccgtctcgagc

SEQ ID NO: 993 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtacgttgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 994 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtggctacacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcggggaaccctggtcaccgtctcgagc

SEQ ID NO: 995 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtacggtaacctgacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 996 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcacggtgggttcacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 997 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccggccggtttctacacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 998 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccggcgggtggcctcacatactacgcagactccgtgaagggccggttcaccatctcccgcgacaattccaagaacacgctgtatctgcaaatgaacagcctgcgtgccgaggataccgcggtatattactgtgcgaaacttccgtttacttttgacgactggggtcagggaaccctggtcaccgtctcgagc

SEQ ID NO: 999 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcgcctttcgggattatgagatgtggtgggtccgccaggctccagggaagggtctagagcgggtctcagctattaatccgcacggttccctcacatactacgcagactccgtgaagggccggttcaccatctcccgcgacaattccaagaacacgctgtatctgcaaatgaacagcctgcgtgccgaggataccgcggtatattactgtgcgaaacttccgtttacttttgaggactggggtcagggaaccctggtcaccgtctcgagc

SEQ ID NO: 1000 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgtgattatgagatgtggtgggtccgccaggctccagggaagggtctagagcgggtctcagctattaatccggccggtgggtacacatactacgcagactccgtgaagggccggttcaccatctcccgcgacaattccaagaacacgctgtatctgcaaatgaacagcctgcgtgccgaggataccgcggtatatcactgtgcgaaacttccgtttacttttgaggactggggtcagggaaccctggtcaccgtctcgagc

SEQ ID NO: 1001 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttggtttacggagtggggtcagggaaccctggtcaccgtctcgagc

SEQ ID NO: 1002 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtgcgaaacttccgttcatgttttccgaccggggtcagggaaccctggtcaccgtctcgagc

SEQ ID NO: 1003 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgtttttgtttcaggagtggggtcagggaaccctggtcaccgtctcgagc

SEQ ID NO: 1004 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgacgcggtttgaggactggggtcagggaaccctggtcaccgtctcgagc

SEQ ID NO: 1005 - DNA, 348 bp, Artificial Sequence; identical to SEQ ID NO: 609
  Description of Artificial Sequence: Synthetic polynucleotide

SEQ ID NO: 1006 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagc

SEQ ID NO: 1007 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgacgttctttaaggactggggtcagggaaccctggtcaccgtctcgagc

SEQ ID NO: 1008 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacacgtacatactacgcagactccgtgaagggccggttcaccatctcccgcgacaattccaagaacacgctgtatctgcaaatgaacagcctgcgtgccgaggataccgcggtatattactgtgcgaaacttccgtttttctttcaggagtggggtcagggaaccctggtcaccgtctcgagc

SEQ ID NO: 1009 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgcagttgtttcacgaccggggtcagggaaccctggtcaccgtctcgagc

SEQ ID NO: 1010 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgcagctctttgaggactggggtcagggaaccctggtcaccgtctcgagc

SEQ ID NO: 1011 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatatcactgtgcgaaacttccgtttgggttttccgagtggggtcagggaaccctggtcaccgtctcgagc

SEQ ID NO: 1012 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgcagttgtttcaggactggggtcagggaaccctggtcaccgtctcgagc

SEQ ID NO: 1013 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgtttttctttcacgagtggggtcagggaaccctggtcaccgtctcgagc

SEQ ID NO: 1014 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgcactactttaaggactggggtcagggaaccctggtcaccgtctcgagc

SEQ ID NO: 1015 - DNA, 348 bp, Artificial Sequence
  Description of Artificial Sequence: Synthetic polynucleotide
gaggtgcagctgttggagtctgggggaggcttggtacagtctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtgcgaaacttccgttttactttgaggagtggggtcagggaaccctggtcaccgtctcgagc

SEQ ID NO: 1016 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggataccgcggtatattactgtgcgaaacttccgtttaggttttccgaccggggtcagggaaccctggtcaccgtctcgagc

SEQ ID NO: 1017 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgacgctgtttcaggactggggtcagggaaccctggtcaccgtctcgagc

SEQ ID NO: 1018 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttacttttccgagtggggtcagggaaccctggtcaccgtctcgaac

SEQ ID NO: 1019 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttggtttcaggagtggggtcagggaaccctggtcaccgtctcgagc

SEQ ID NO: 1020 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggttcgttgacatactacgcagactccgtgaagggccggttcaccatctcccgcgacaattccaagaacacgctgtatctgcaaatgaacagcctgcgtgccgaggacaccgcggtatattactgtgcgaaacttccgttttactttcaggagtggggtcagggaaccctggtcaccgtctcgagc

SEQ ID NO: 1021 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggttcgttgacatactacgcagactccgtgaagggccggttcaccatctcccgcgacaattccaagaacacgctgtatctgcaaatgaacagcctgcgtgccgaggataccgcggtatatcactgtgcgaaacttccgatgttctttgaggactggggtcagggaaccctggtcaccgtctcgaac

SEQ ID NO: 1022 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggttcgttgacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagc

SEQ ID NO: 1023 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggttcgttgacatactacgcagactccgtgaagggccggttcaccatctcccgcgacaattccaagaacacgctgtatctgcaaatgaacagcctgcgtgccgaggacaccgcggtatattactgtgcgaaacttccgtttttctttcaggagtggggtcagggaaccctggtcaccgtctcgagc

SEQ ID NO: 1024 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggttcgttgacatactacgcagactccgtgaagggccggttcaccatctcccgcgacaattccaagaacacgctgtatctgcaaatgaacagcctgcgtgccgaggacaccgcggtatattactgtgcgaaacttccgtttttctttcacgagtggggtcagggaaccctggtcaccgtctcgagc

SEQ ID NO: 1025 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttcacatactacgcagactccgtgaagggccggttcaccatctcccgcgacaattccaagaacacgctgtatctgcaaatgaacagcctgcgtgccgaggataccgcggtatattactgtgcgaaacttccgttttactttcaggagtggggtcagggaaccctggtcaccgtctcgagc

SEQ ID NO: 1026 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttcacatactacgcagactccgtgaagggccggttcaccatctcccgcgacaattccaagaacacgctgtatctgcaaatgaacagcctgcgtgccgaggataccgcggtatatcactgtgcgaaacttccgatgttctttgaggactggggtcagggaaccctggtcaccgtctcgaac

SEQ ID NO: 1027 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttcacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagc

SEQ ID NO: 1028 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttcacatactacgcagactccgtgaagggccggttcaccatctcccgcgacaattccaagaacacgctgtatctgcaaatgaacagcctgcgtgccgaggacaccgcggtatattactgtgcgaaacttccgtttttctttcaggagtggggtcagggaaccctggtcaccgtctcgagc

SEQ ID NO: 1029 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttcacatactacgcagactccgtgaagggccggttcaccatctcccgcgacaattccaagaacacgctgtatctgcaaatgaacagcctgcgtgccgaggataccgcggtatattactgtgcgaaacttccgtttttctttcacgagtggggtcagggaaccctggtcaccgtctcgagc

SEQ ID NO: 1030 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttgacatactacgcagactccgtgaagggccggttcaccatctcccgcgacaattccaagaacacgctgtatctgcaaatgaacagcctgcgtgccgaggataccgcggtatattactgtgcgaaacttccgttttactttcaggagtggggtcagggaaccctggtcaccgtctcgagc

SEQ ID NO: 1031 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttgacatactacgcagactccgtgaagggccggttcaccatctcccgcgacaattccaagaacacgctgtatctgcaaatgaacagcctgcgtgccgaggataccgcggtatatcactgtgcgaaacttccgatgttctttgaggactggggtcagggaaccctggtcaccgtctcgaac

SEQ ID NO: 1032 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttgacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagc

SEQ ID NO: 1033 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttgacatactacgcagactccgtgaagggccggttcaccatctcccgcgacaattccaagaacacgctgtatctgcaaatgaacagcctgcgtgccgaggataccgcggtatattactgtgcgaaacttccgtttttctttcaggagtggggtcagggaaccctggtcaccgtctcgagc

SEQ ID NO: 1034 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgtggggtgggttgacatactacgcagactccgtgaagggccggttcaccatctcccgcgacaattccaagaacacgctgtatctgcaaatgaacagcctgcgtgccgaggataccgcggtatattactgtgcgaaacttccgtttttctttcacgagtggggtcagggaaccctggtcaccgtctcgagc

SEQ ID NO: 1035 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatatcactgtgcgaaacttccgatgttctttgaggactggggtcagggaaccctggtcaccgtctccagc

SEQ ID NO: 1036 - DNA, 357 bp, Artificial Sequence
  Description of Artificial Sequence: Synthetic polynucleotide
gaggtgcagctgttggagactgggggaggcttggtacagcctggggggtccctgcgtctctcctgtgcagcctccggattcaccttttcgacttatcatatgcagtgggtccgccgggctccagggaagggcctggagtgggtctcaatgattgatgcggatggtcttgggacatactacgcagaccccgtgaagggccggttcaccatctcccgcgacaattccaagaacacgctgtatctgcaaatgaacagcctgcgtgccaaggacaccgcggtatattactgtgcgagaccgggtccgcagtttggtcagtttgactacttgggtcagggaaccctggtcaccgtctcgagc

SEQ ID NO: 1037 - DNA, 357 bp, Artificial Sequence
  Description of Artificial Sequence: Synthetic polynucleotide
gaggtgcagctgtttgagtctgggggaggcttggtacagactggggggtccctgcgtctctcctgtgcagcctccggattcaccttttcgacttatcatatgcagtgggtccgccaggctccagggaagggtctggagtgggtctcaatgattgatgcggatggtcttgggaaatactacgcagaccccgtgaagggccggttcaccatctcccgcgacaattccaagaacacgctgtatctgcaaatgaacagcctgcgtgccgaggacaccgcggtatattactgtgtgaaaccgggtccgcagtttggtcagtatgactactggggtcagggaaccctggtcaccgtctcgagc

SEQ ID NO: 1038 - DNA, 363 bp, Artificial Sequence
  Description of Artificial Sequence: Synthetic polynucleotide
gaggtgcagctgttggagtcagggggaggcttggtacagcctggggggtccctgcggctctcctgttcagcttccggattcaccttttcggggtatgatatgcagtgggtccgccaggctccagggaagggtctagagtgggtctcaacgattagtgcgtcgggtgtttatacatactacgcagactccgtgaagggccggttcaccatctcccgcgacaattccaagaacacgctgtatctgcaaatgaacagcctgcgtgccgaggacaccgcggtatattactgtgcgaaatatcctaatcgttttgcgcttaatagttttgactacaggggtcggggaaccctggtcaccgtctcgagc

SEQ ID NO: 1039 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcttccggattcaccttttcggggtatgatatgcagtgggtccgccaggctccagggaggggtctagagtgggtctcaacgattagtgcgtcgggtgtttatacatactacacagactccgtgaagggccggttcaccacctcccgcgacaattccaagaacacgctgtatctgcaaatgaacagcctgcgtgccgaggacaccgcggtatattactgtacgaaatatccaaatcgttttgcgcgtaataattttgactactggggtcagggaaccctggtcaccgtctcgagc

SEQ ID NO: 1040 - DNA, 324 bp, Artificial Sequence
  Description of Artificial Sequence: Synthetic polynucleotide
gacatcctgatgacccagtctccatcctccctgtctgcatctgtaggagaccgtgtcaccatcacttgccgggcaaatagttctattttgtgggcgttagcttggtaccagcagaaaccaggggaagcccctaagctcctgatcgagagttcttccggtttgcaaagtggggtcccatcacgtttcagtggcagtggatctgggacagatttcactctcaccatcagcagtctgcaacctgaagattttgctacgtactactgtgttcagaatgcggtttggcctggtacgttcagccaagggaccaaggtggaaatcaaacgg

SEQ ID NO: 1041 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcagacagttctattttgtgggcgttagcttggtaccagcagaaaccagggaaagcccctaagctcctgatcgagagttcatccggtttgcaaagtggggtcccatcacgtttcagtggcagtggatctgggacagatttcactctcaccatcagcagtctgcaacctgaagattttgctacgtactactgtgttcagaatgcggtttggcctggtacgttcggccaagggaccaaggtggaaatcaaacgg

SEQ ID NO: 1042 - DNA, 324 bp, Artificial Sequence
  Description of Artificial Sequence: Synthetic polynucleotide
gacatccagatgaccgtgtctccatcctccctgtctgcatctgtaggagaccgtgtcaccatcacttgccgggcagatagttctattttgtgggcgttagcttggtaccagcagaaaccagggaaagcccctaagctcctgatcgagagttcttccggattgcaaagcggggtcccatcacgtttcagtggcagtggatctgggacagatttcactctcaccatcagcagtctgcaacctgaagattttgctacgtactactgtgttcagaatgcggtttggcctggtacgttcggccaagggaccaaggtggaaatcaaacgg

SEQ ID NO: 1043 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaaatagttctattttgtgggcgttagcttggtaccagcagaaaccagggaaagcccctaagctcctgatcgagagttcttccggtttgcaaagtggggtcccatcacgtttcagtggcagtggatctgggacagatttcactctcaccatcagcagtctgcaacctgaagattttgctacgtactactgtgttcagaatgcggtttggcctggtacgttcgaccaagggaccaaggtggaaatcaaacgg

SEQ ID NO: 1044 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaaatagttctattttgtgggcgttagcttggtaccagcagaaaccagggaaagcccctaagctcctgatcgagagttctaccggtttgcaaagtggggtcccatcacgtttcagtggcagtggatctgggacagatttcactctcaccatcagcagtctgcaacctgaagattttgctacgtactactgtgttcagaatgcggtttggcctggtacgttcggccaagggaccaaggtggaaatcaaacgg

SEQ ID NO: 1045 - DNA, 324 bp, Artificial Sequence
  Description of Artificial Sequence: Synthetic polynucleotide
gacatccagatgaccgtgtctccatcctccctgtctgcatctgtaggagaccgtgtcaccatcacttgccgggcaaatagttctattttgtgggcgttagcttggtaccagcagaaaccagggaaagcccctaagctcctgatcgagagttcttccggattgcaaagcggggtcccatcacgtttcagtggcagtggatctgggacagatttcactctcaccatcagcagtctgcaacctgaagattttgctacgtactactgtgttcagaatgcggtttggcctggtacgttcggccaagggaccaaggtggaaatcaaacgg

SEQ ID NO: 1046 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcagatagttctattttgtgggcgttagcttggtaccagcagaaaccagggaaagcccctaagctcctgatcgagagttcttccggtttgcaaagtggggtcccatcacgtttcagtggcagtggatctgggacagatttcactctcaccatcagcagtctgcaacctgaagattttgctacgtactactgtgttcagaatgcggtttggcctggtacgttcgaccaagggaccaaggtggaaatcaaacgg

SEQ ID NO: 1047 - DNA, 324 bp, Artificial Sequence
  Description of Artificial Sequence: Synthetic polynucleotide
gacatccagatgacccagtctccatcctcactgtctgcatctgtaggagaccgtgtcaccatcacttgccgggcaaatagttctattttgtgggcgttagcttggtaccagcagaaaccagggaaagcccctgagctcctgatcgagagttcttccggtctgcaaagtggggtcccatcacgtttcagtggcagtggatctgggacagatttcactctcaccatcagcagtctgcaacctgaagattttgctacgtactactgtgttcagaatgcggtttggcctggtacgttcggccaagggaccaaggtggaaatcaaacgg

SEQ ID NO: 1048 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcgaatagttctatattgtgggcgttggcttggtaccagcagaaaccagggaaagcccctaagctcctgatcgagagttcttccggtttgcaaagtggggtcccatcacgtttcagtggcagtggatctgggacagatttcactctcaccatcagcagtctgcaacctgaagattttgctacgtactactgtgttcagaatgcggtttggcctggtacgttcggccaagggaccaaggtggaaaacaaacgg

SEQ ID NO: 1049 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaaatagttctattctgtgggcgttagcttggtaccagcagaaacctgggaaagcccctaagctcctgatcgagagttcttccggtttgcaaagtggggtcccatcacgtttcagtggcagtggatctgggacagatttcactctcaccatcagcagtctgcaacccgaagattttgctacgtactactgtgttcagaatgcggtttggcctggtacgttcggccaagggaccaaggtggaaatcaaacgg

SEQ ID NO: 1050 - DNA, 324 bp, Artificial Sequence
  Description of Artificial Sequence: Synthetic polynucleotide
gacatccagatgacccagtctccatcctccctgtctgcttctgtaggagaccgtgtcaccatcacttgccgggcaaatagttctattttgtgggcgttagcttggtaccagcagaaaccagggaaagcccctaagctcctgatcgagagttcttccggtttgcaaagtgggatcccatcacgtttcagtggcagtggatctgggacagatttcactctcaccatcagcagtctgcaacctgaagattttgctacgtactactgtgttcagaatgcggtttggcctggtacgttcggccaagggaccaaggtggaaatcaaacgg

SEQ ID NO: 1051 - DNA, 324 bp, Artificial Sequence
  Description of Artificial Sequence: Synthetic polynucleotide
gacatccagatgacccagtctccatcctccctgtctgcatctgttggagaccgtgtcaccatcacttgccgggcaaatagttctattttgtgggcgttagcttggtaccagcagaaaccagggaaagcccctaagctcctgatcgagagttcttccggattgcaaagcggggtcccatcacgtttcagtggcagtggatctgggacagatttcactctcaccatcagcagtctgcaacctgaagattttgctacgtactactgtgttcagaatgcggtttggcctggtacgttcggccaagggaccaaggtggaaatcaaacgg

SEQ ID NO: 1052 - DNA, 324 bp, Artificial Sequence
  Description of Artificial Sequence: Synthetic polynucleotide
gacatcctgttgacccagtctccatcctccctgtctgcatctgtaggagaccgtgtcaccatcacttgccgggcaaatagttctattttgtgggcgttagcttggtaccagcagaaaccagggaaagcccctaagctcctgatcgagagttcttccggtttgcaaagtggggtcccatcacgtttcagtggcagtggatctgggacagatttcactctcaccatcagcagtctgcaacctgaagattttgctacgtactactgtgttcagaatgcggtttggcctggtacgttcggccaagggaccaaggtggaaatcaaacgg

SEQ ID NO: 1053 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaaatagttctattttgtgggcgttagcttggtaccagcagaaaccagggaaagcccctaagctcctgatcgagagttcttccggtttgcaaagtggggtcccatcacgtttcagtggaagtggaactgggacagatttcactctcaccatcagcggtctgcaacctgaagattttgctacgtactactgtgttcagaatgcggtttggcctggtacgttcgaccaagggaccaaggtggaaatcaaacgg

SEQ ID NO: 1054 - DNA, 324 bp, Artificial Sequence
  Description of Artificial Sequence: Synthetic polynucleotide
gacatccagatgacccagtctccatcctccctgtctgcatctgtaggagaccgtgtcaccatcccttgccgggcaaatagttctattttgtgggcgttagcttggtaccagcagaaaccagggaaagcccctaagctcctgatcgagagttcttccggtttgcaaagtggggtcccatcacgtttcagtggcagtgcatctgggacagatttcactctcaccatcagcagtctgcaacctgaagattttgctacgtactactgtgttcagaatgcggtttggcctggtacgttcggccaagggaccaaggtggagatcaaacgg

SEQ ID NO: 1055 - DNA, 324 bp, Artificial Sequence
  Description of Artificial Sequence: Synthetic polynucleotide
gacatccagatggcccagtctccatcctccctgtctgcatctgtaggagaccgtgtcaccatcacttgccgggcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgcgagtccacctttgacgttaggccaagggaccaaagtggaaatcaaacgg

SEQ ID NO: 1056 - DNA, 324 bp, Artificial Sequence
  Description of Artificial Sequence: Synthetic polynucleotide
gacatccagatgacccagtctccatcctccctgtctgcatctgtaggagacagtgtcaccatcacttgccgggcaagtcagacgattgagcgtcgtttaaattggtatcagcagaaaccaggggaagcccctaagctcctgatctatcttgcttcccgtttgcaaagtggggtcccatcacgtttcagtggcagtggatctgggacagatttcactctcaccatcagcagtctgcaacctgaagattttgctacgtactactgccatcagtatgcgagtccacctttgacgttcggccaagggaccaatgtggaaatcaaacgg

SEQ ID NO: 1057 - DNA, 324 bp, Artificial Sequence
  Description of Artificial Sequence: Synthetic polynucleotide
gacatccagatgacccagtctccatcctccctatctgcatctgtaggagaccgtgtcaccatcacttgccgggcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctgcgtactactgtcatcagtacgagagtccacctttgacgtttggccaagggaccaaagtggaaatcaaacgg

SEQ ID NO: 1058 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcggacgattgagcgtcgtttaaattggtatcagcagaaaccagggaaagcccctaagctcctgatctatcttgcttcgcgtttgcaaagtggggtcccatcacgtttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1059 - DNA, 324 bp, Artificial Sequence
  Description of Artificial Sequence: Synthetic polynucleotide
gacatccagatgacccagtctccatcctccctgtctgcatctgtaggagaacgtgtcaccatcacttgccgggcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagatttcactctcaccatcagcaatctgcaacctgaagattctgctacgtactactgtcatcagtatgcgagtccacctttgacgttaggccaagggaccaaagtggaaatcaaacgg

SEQ ID NO: 1060 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagccagacgattgagcgtcgtttaaattggtatcagcagaaaccagggaaggcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgcgagtccacctttgacgttaggccaagggaccaaagtggaaatcaaacgg

SEQ ID NO: 1061 - DNA, 324 bp, Artificial Sequence
  Description of Artificial Sequence: Synthetic polynucleotide
gacatccagataacccagtctccatcctccctgtctgcatctgtaggagaccgtgtcaccatcacttgccgggcaagtcagacgattgagcgtcgtttaaattggtatcagcagaaaccagggaaagaccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgagagtcctcctttgacgttcggccaagggaccaaagtggaaatcaaacgg

SEQ ID NO: 1062 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagacgattgagcgtcgtttaaattggtatcagcagaaaccaggggaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgagagtccacctttgacgttcggccaagggaccaaagtggaaatcaaatgg

SEQ ID NO: 1063 - DNA, 324 bp, Artificial Sequence
  Description of Artificial Sequence: Synthetic polynucleotide
gacatccagttgacccagtctccatcctccctgtctgcatctgtaggagaccgagtcaccatcacttgccgggcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagaattcactctcaccatcagcagtctgcaacctgaagattttgctacgtactactgtcatcagtatgagagtccacctttgacgttcggccaagggaccaaagtggaaatcaaacgg

SEQ ID NO: 1064 - DNA, 324 bp, Artificial Sequence
  Description of Artificial Sequence: Synthetic polynucleotide
gacatccagatgtcccagtctccatccaccctgtctgcatctgtaggagaccgtgtcaccatcacttgccgggcaagtcagacgattgagcgtcgtttaaattggtatcagcagaaaccagggaaagcccctaagctcctgatctatcttgcttcccgcttgcaaagtggggtcccatcacgtttcagtggcagtggatctgggacagatttcactctcaccatcagcagtctgcaacctgaagattttgctacgtactactgtcatcagtatgagagtccacctttgatgttcggccaagggaccaaagtggaaatcaaacgg

SEQ ID NO: 1065 - DNA, 324 bp, Artificial Sequence
  Description of Artificial Sequence: Synthetic polynucleotide
gacatccagatgacccagtctccatcctccctgtctgcatctgtaggagaccgtgtcaccattacttgccgggcaagtcagacgattgagcgtcgtttaaattggtatcagcagaaaccagggaaagaccctaagctcctgatctatcttgcttcccgtttgcaaagtggggtcccatcacgtttcagtggcagtggatctgggacagatttcactctcaccatcagcagtctgcaaccagaagattttgctacgtactactgtcatcagtatgagagtccacctttgacgttcggccaagggaccaaagtggaaatcaaacgg

SEQ ID NO: 1066 - DNA, 324 bp, Artificial Sequence
  Description of Artificial Sequence: Synthetic polynucleotide
gacatccagatgacccagtctccatcctccctgtctgcatccgtaggagaccgtgtcaccatcacttgccgggcaagtcagacgattgagcgtcgtttaaactggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1067 - DNA, 324 bp, Artificial Sequence
  Description of Artificial Sequence: Synthetic polynucleotide
gacatccagatgacccagtctccatcctccctgtttgcatctgtaggggaccgtgtcaccatcacttgccgggcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1068 - DNA, 324 bp, Artificial Sequence
  Description of Artificial Sequence: Synthetic polynucleotide
gacatccagatgacccagtatccatcctccctgtctgcatctgtaggagaccgtgtcaccatcacttgccgggcaagtcagtcgattgagcgtcgtttaaattggtatcagcagaaaccaggggaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgagagtccacctttgacgttcggccaagggactaaagtggaaatcaaacgg

SEQ ID NO: 1069 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcggacgattgagcgtcgtttaaattggtatcagcagaaaccagggaaagcccctaagctcctgatctatcttgcttcgcgtttgcaaagtggggtcccatcacgtttcagtggcagtggatctgggacagatttcactctcaccatcagcagtctgcaacctgaagattttgctacgtactactgtcatccgtatgagagtccacctttgacgttcggccaagggaccaaagtggaaatcaaacgg

SEQ ID NO: 1070 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcaggcgattgagcgtcgtttaaattggtatcagcagaaaccagggaaagcccctaagctcctgatctatcttgcttcccgtttgcaaagtggggtcccatctcgtttcagtggcagtggatctgggacagatttcactctcaccatcagcagtctgcagccagaagattttgctacgtactactgtcatcagtatgcgagtccacctttgacgctcggccaagggaccaaagtggaaatcaaacgg

SEQ ID NO: 1071 - DNA, 324 bp, Artificial Sequence
  Description of Artificial Sequence: Synthetic polynucleotide
aacatccagatgacccagtctccatcctccctgtctgcatctgtaggagaccgtgtcaccatcacttgccgggcaagtcaggcgattgagcgtcgtttaaattggtatcagcagaaaccagggaaagcccctaagctcctgatctatcttgcttctcgtttgcaaagtggggtcccatcacgtttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1072 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagacgattgggcgtcgtttaaattggtatcagcagaaaccagggaaagcccctaagctcctgatctatcttgcttcccgtttgcaaagtggggtcccatcacgtttcagtggcagtggatctgggtcagatttcactctcaccatcagcagtctgcaacctgaagattttgctacgtactactgtcatcagtatgagagtccacctttgacgttcggccaagggaccaaagtggaaatcaaacgg

SEQ ID NO: 1073 - DNA, 324 bp, Artificial Sequence
  Description of Artificial Sequence: Synthetic polynucleotide
gacatccagatgacccagtctccatcctccctttctgcatctgtaggagaccgtgtcaccatcacttgccgagcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagaatttactctcaccatcagcagtctgcaacctgaagattttgctacgtactactgtcatcagtatgagagtccacctttgacgttcggccaagggaccaaagtggaaatcaaacgg

SEQ ID NO: 1074 - DNA, 324 bp, Artificial Sequence
  Description of Artificial Sequence: Synthetic polynucleotide
gacatccagatgacccagactccatcctccctgtctgcatctgtaggagaccgtgtcaccatcacttgccgggcaagtcagacgattgagcgtcgtttaaattggtatcagcagaaaccaggggaagcccctaagctcctgatctatcttgcttcccgtttgcaaagtggggtcccatcacgtttcagtggcagtggatctgggacagatttcactctcaccatcagcagtctgcaacctgaagattttgccacgtactactgtcatcagtatgagagtccacctttgacgttcggccaagggaccaaagtgaaaatcaaacgg

SEQ ID NO: 1075 - DNA, 324 bp, Artificial Sequence
  Description of Artificial Sequence: Synthetic polynucleotide
gacatccagatgacccagtctccatcctccctgtctgcatctgtaggagacagtgtcaccatcacttgccgggcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacccgaagattttgctacgtactactgtcatcagtatgagagtccacctttgacgttcggccaagggaccaaagtggaaatcaaacgg

SEQ ID NO: 1076 - DNA, 324 bp, Artificial Sequence
  Description of Artificial Sequence: Synthetic polynucleotide
cacatccagatgacccagtctccatcctccctgtctgcatctgtaggagaccgtgtcaccatcacttgccgggcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctacgtactactgccatcagtatgagagtccacctttgacgttcggccaagggaccaaagtggaaatcaaacgg

SEQ ID NO: 1077 - DNA, 324 bp, Artificial Sequence
  Description of Artificial Sequence: Synthetic polynucleotide
gacgtccagatgacccagtctccatcctccctgtctgcatctgtaggagaccgtgtcaccatcacttgccgggcaagtcagacgattgagcgtcgtttaaattggtatcagcagaaaccaggggaagcccctaagctcctgatctatcttacttcccgtttgcaaagcggggtcccatcacgtttcagtggtagtggatctgggacagatttcactctcaccatcagcagtctgcaacctgaagattttgctacgtactactgccatcagtatgcgagtccacctttgacgttcggccaagggaccaaggtggaaatcaaacgg

SEQ ID NO: 1078 - DNA, 324 bp, Artificial Sequence
  Description of Artificial Sequence: Synthetic polynucleotide
gacatccagatgacccagtcgccatcctccctgtctgcatctgtaggagaccgtgtcaccatcacttgccgggcaagtcagacgattgagcgtcgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcaccagtatgagagtccacctttgacgttcggccaagggaccaaagtggtaatcaaacgg

SEQ ID NO: 1079 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcagacgattgagcgtcgtttaaattggtatcagcagaaacctgggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1080 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagccgattgagcgtcgtttaaattggtatcagcagaagccagggaaagcccctaagctcctgatctatcttgcttcccgtttgcaaagtggggtcccatcacgtttcagtggcagtggatctgggacagatttcactctcaccatcagcagtctgcaacctgaagattttgctacatactactgtcatcagtatgagagtccacctttgacgttcggccaagggaccaaagtggaaatcaaacgg

SEQ ID NO: 1081 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagacgattgggcgtcgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1082 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtcgattgagcgccgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgagagtcctcctttgacgttcggccaagggaccaaagtggaaatcatacgg

SEQ ID NO: 1083 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcagacgattgagcgtcgtttaaattggtatcagcagaaacctgggaaagcccctaagctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1084 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtcgattgagcgccgtttaaattggtatcagcagaaaccagggaaagcccctaagctcctgatctatcttgcttcccgtttgcaaagtggggtcccatcacgtttcagtggcagtggatctgggacagatttcactctcaccatcagcagtctgcaacctgaagattttgctacgtactactgtcatcagtatgagagtcctcctttgacgttcggccaagggaccaaagtggaaatcaaacgg

SEQ ID NO: 1085 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcagacgattgagcgtcgtttaaattggtatcagcagaaacctgggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagttcgagcacccacctttgacgttcggccaagggaccaaagtggaaatcaaacgg

SEQ ID NO: 1086 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtttccccattgaccgtcgtttaaattggtatcagcagaaacctgggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1087 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagttccaccattggccgtcgtttaaattggtatcagcagaaacctgggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1088 - DNA, 324 bp, Artificial Sequence
  Description of Artificial Sequence: Synthetic polynucleotide
gacatccagatgacccagtctccatcctccctgtctgcatctgtaggagaccgagttaccatcacttgccgggcaagttcccagattgggcgtcgtttaaattggtaccagcagaaaccagggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1089 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtgagcggattgggcgtcgtttaaattggtatcagcagaaaccagggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1090 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcagcagattggccgccgtttaaattggtatcagcagaaacctgggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1091 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcagccgattgcccggcgtttaaattggtaccagcagaaaccagggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1092 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtgggaacattggccgtcgtttaaattggtaccagcagaaaccagggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaagcgg

SEQ ID NO: 1093 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcggaacattgaccgtcgtttaaattggtaccagcagaaaccagggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1094 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcagagcattgggcgtcgtttaaattggtaccagcagaaacctgggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1095 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcagaacattgggacgcgtttaaattggtaccagcagaaaccagggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1096 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtgaggtcattgggcgtcgtttaaattggtaccagcagaaaccagggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1097 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtgaggcgattggccgtcgtttaaattggtatcagcagaaaccagggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1098 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtaccagcattgcgcgtcgtttaaattggtatcagcagaaacctgggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1099 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtttgaacattgggcgtcgtttaaattggtaccagcagaaaccagggaaagcccctaggctcctgatctatcttgctacccgtttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1100 - DNA, 324 bp, Artificial Sequence
  Description of Artificial Sequence: Synthetic polynucleotide
gacatccagatgacccagtctccatcctccctgtctgcatctgtaggagaccgagtcaccatcacttgccgggcaagtcagacgattgagcgtcgtttaaattggtaccagcagaaaccagggaaagcccctaggctcctgatctatctttcgtcgaagttgcaaagtggggtcccatcacgcttcagtggcagtggatctgggacagatttcactctcaccatcagcagtctgcaacctgaagattttgctacgtactactgtcatcagtatgagagtccacctttgacgttcggccaagggaccaaagtggaaatcaaacgg

SEQ ID NO: 1101 - DNA, 348 bp, Artificial Sequence
  Description of Artificial Sequence: Synthetic polynucleotide
gaggtgcagctgttggagtctgggggaggcttggttcagcctggggggtccctgcgtctctcctgtgcagcctccggatccaccattgctgggtatgagatgtggtgggtccgccaggctccagggaagggtctagagcgtgtctcagctattagtggtagtggtggtagcacatactacgcagactccgtgaagggccggttcaccatctcccgagacgattccaagaacacgctgtatctgcaaatgaacagcctgcgtgccgaggataccgcggtatattactgtgcgagagatccttatagttttgactactggggtcagggaaccctggtcaccgtctcgagc

SEQ ID NO: 1102 - DNA, 348 bp, Artificial Sequence
  Description of Artificial Sequence: Synthetic polynucleotide
gaggtgcagccgttggagtctgggggaggcttggtacagcctggggggtccctgcgtctctcctgtgcagcctccggattcacctttgctgggtatgagatgtggtgggtccgccaggctccagggaagggtctagagcggatctcagctattagcggtagtggtggtagcacatactacgcagactccgtgaagggccggttcaccatctcccgcgacgattccaagaacacgctgtatctgcaaatgaacagcctgcgtgccgaggataccgcggtatattactgtgcgagagatccttatagttttgactactggggtcagggaaccctggtcaccgtctcgagc

SEQ ID NO: 1103 - DNA, 348 bp, Artificial Sequence
  Description of Artificial Sequence: Synthetic polynucleotide
gaggtgcagctgttggagtctgggggaggctcggtacagcctggggggtccctgcgtctctcctgtgcagccaccggatccacctttgctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgagagatccttacagttatgactactggggtcagggaaccctggtctccgtctcgagc

SEQ ID NO: 1104 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggactcacctttgctgggtatgagatgtggtgggtccgccaggcaccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcagtatatcactgtgcgagagatccttatagttttgactactggggtcagggaaccctggtcaccgtctcgagc

SEQ ID NO: 1105 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctccagggaagggtctagagcgggtctcagctattagtggtagtggtggtagcacatactacgcagactctgtgaagggccggttcaccatctcccgcgacgattccaagaacacgctgtatctgcaaatgaacagcctgcgtgccgaggataccgcggtatatcactgtgcgaaagaaccttatagttatgactactggggtcagggaaccctggtcaccgtctcgagc

SEQ ID NO: 1106 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggatccacctttgctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtcccgaggataccgcggtatattactgtgtgaaagatccttatagttttgactactggggtcagggaaccctggtcaccgtctcgagc

SEQ ID NO: 1107 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggatccaccattgccgggtatgagatgtggtgggtccgccaggctccggggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgagagatccttatagttttgactactggggtcagggaaccccggtcaccgtctcgagc

SEQ ID NO: 1108 - DNA, 348 bp, Artificial Sequence
  Description of Artificial Sequence: Synthetic polynucleotide
gaggtgcagctgatggagtctgggggaggcttggtacagcctggggggtccctgcgtctctcctgtgcagcctccggatccacctttgctgggtatgagatgtggtggtaccgccaggctccagggaagggtctagagcgggtctcagctattagtggaagtggtagaagcacatactacgcagactccgtgaagggccggttcaccatctcccgcgacgattccaagaacacgctgtatctgcaaatgaacagcctgcgtgccgaggataccgcggtatattactgtgcgaaagatccttatagttttgactactggggtcagggaaccctggtcaccgtctcgagc

SEQ ID NO: 1109 - DNA, 348 bp, Artificial Sequence
  Description of Artificial Sequence: Synthetic polynucleotide
gaggtgcagctgctggagtctgggggaggcttggtacagcctggggggtccctgcgtctctcctgtgcagcctccggattcacctttgctgggtatgagatgtggtgggtccgccaggctccagggaagggtctagagcgggtctcagctattagtggtagtggtggtagcacgtactacgcagactccgtgaagggccggttcaccatctcccgcgacgattccaagaacacgctgtatctgcaaatgaacagcctgcgtgccgaggataccgcagtatattactgtgcgaaagaaccttatagttttgactactggggtcagggaaccctggtcaccgtctcgagc

SEQ ID NO: 1110 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggatccaccattgctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgaaagatccatatagttttgactactggggtcagggaaccctggtcaccgtctcgagc

SEQ ID NO: 1111 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgagagacccttatagttttgactactggggtcagggaaccctggtctccgtctcgagc

SEQ ID NO: 1112 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccattgctgggtatgagatgtggtgggtccgccaggctccagggaagggtctagagcgggtctccgctattagtggtagtggtggtagcacatactacgcggactccgtgaagggccggttcaccatctcccgcgacgattccaagaacacgctgtatctgcaaatgaacagcctgcgtgccgaggataccgcggtatattactgtgcgaaagatccttatagttttgactactggggtcagggaaccctggtcaccgtttcgagc

SEQ ID NO: 1113 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctccagggaagggtctagagcgtgtctcagctattagtggtagtggtggtagcacatactacgcagactccgtgaagggccggttcaccatcacccgcgacgattccaagaacacgctgtatctgcaaatgaacagcctgcgtgccgaggataccgcggtatattactgtgcgaaagagccttatagttttgactactggggtcagggaaccctggtcaccgtctcgagc

SEQ ID NO: 1114 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtggttccgccaggctccagggaagggtctagagcgggtctcagctattagtggtagtggtggtagcacatactacgcagactccgtgaagggccggttcaccatctcccgcgacgataccaagaacacgctgtatctgcaaatgaacagcctgcgtgccgaggataccgcggtatattactgtgcgaaagatccttatagttttgactactggcgtcagggaaccctggtcaccgtctcgagc

SEQ ID NO: 1115 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggatccacctttgctgggtatgaggtgtggtgggtccgccaggctccagggaagggtctggagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgagagatccttatagttttgactactggggtcagggaaccctggtcaccgtctcgagc

SEQ ID NO: 1116 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggatccacctttgctgggtatgagatgtggtgggtccgccaggctccagggaagggtctagagcggatctcagctattagtggtagtggtggtagcacatactacgcagactccgtgaagggccggttcaccatctcccgcgacgattccaagaacacgctgtatctgaaaatgaacagcctgcgtgccgaggataccgcggtatattactgtgcgaaagatccttatagttttgactactggggtcagggaaccctggtcaccgtctcgagc

SEQ ID NO: 1117 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgagagatccttatagttttgactactggggtcagggaaccctggtcaccgtctcgagc

SEQ ID NO: 1118 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggactcacctttgctgggtatgagatgtggtgggtccgccgggctccagggaagggtctagagcgggtcgcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgagagatccttatagttttgactactggggtcagggaaccctggtcaccgtctcgagc

SEQ ID NO: 1119 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagttgtggtgggtccgccaggccccagggaagggtctagagcgggtctcagctattagtggaagtggtggtagcacatactacgcagactccgtgaagggccggttcaccatctcccgcgacgattccaagaacacgctgtatctgcaaatgaacagcctgcgtgccgaggataccgcggtatattactgtgcgagagatccttatagttttgactaccggggtcagggaaccctggtcaccgtctcgagc

SEQ ID NO: 1120 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcccccggattcaccttagctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgaaagaaccttatagttttgactactggggtcagggaaccctggtcaccgtctcgagc

SEQ ID NO: 1121 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggactcacctttgctgggtatgagatgtggtgggtccgtcgggctccagggaagggtctagagcgggtctcagctattagtggtagtggtggtagcacatactacgcagactccgtgaagggccggttcaccacctcccgcgacgattccaagaacacgctgtatctgcaaatgaacagcctgcgtgccgaggataccgcggtatattactgtgcgagagatccttatagttttgactactggggtcggggaaccctggtcaccgtctcgagc

SEQ ID NO: 1122 - DNA, 348 bp, Artificial Sequence
  Description of Artificial Sequence: Synthetic polynucleotide
gaggtgcagctgttggagtctgggggaggcttggtacagcccggggggtccctgcgtctctcctgtgccgcctccggattcacctttgctgggtatgagatgtggtgggtccgccaggctccagggaagggtctagagcgggtctcagctattagtggtagcggtggtagcacatactacgcagactccgtgaagggccggttcaccatctcccgcgacgattccaagaacacgctgtatctgcaaatgaacagcctgcgtgccgaggataccgcggtatattactgtgcgaaagaaccttatagttatgactactggggtcatggaaccctggttactgtctcgagc

SEQ ID NO: 1123 - DNA, 348 bp, Artificial Sequence
  Description of Artificial Sequence: Synthetic polynucleotide
gaggtgcagccgttggagtctgggggaggcttggtacagcctggggggtccctgcgtctctcctgtgcagcctccggattcacctttgctgggtatgagatgtggtgggtccgccaggctccagggaagggtctagagcgggtctcagctattagtggtagtggtggtaacacatactacgcagactccgtgaagggccggttcaccatctcccgcgacgattccaagaacacgctgtatctgcaaatgaacagcctgcgtgccgaggataccggggtatattactgtgcgagagatccttatagttttgactactggggtcagggtaccctggtcaccgtctcgagc

SEQ ID NO: 1124 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgaaagaaccttatagttttgactcctggggtcagggaaccctggtcaccgtctcgagc

SEQ ID NO: 1125 - DNA, 348 bp, Artificial Sequence
  Description of Artificial Sequence: Synthetic polynucleotide
gaggcgcagctgttggagtctgggggaggcttggtacagcctggggggtccctgcgtctctcctgtgcagcctccggattaaccttcgctgggtatgagatgtggtgggtccgccaggctccagggaagggtctagagcgcgtctcagctattagtggtagtggcggtagcacatactacgcagactccgtgaagggccggttcaccatctcccgcgacgattccaagaacacgctgtatctgcaaatgaacagcctgcgtgccgaggataccgcggtatattactgtgcgagagatccttatagttttgactactggggtcagggaaccctggtcaccgtctcgagc

SEQ ID NO: 1126 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggatccacctttgctgggtatgagatgtggtgggtccgccaggctccagggaagggtctagagcgggtctcagctattagtggtagtggtggtagcacatactacgcagactccgtgaagggccggttctccatctcccgcgacgattccaagaacacgctgtatctgcaaatgaacagcctgcgtgccgaggataccgcggtatattactgtgcgaaagaaccttatagttttgaccactggggtcagggaaccctggtcaccgtctcgagc

SEQ ID NO: 1127 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctcgggatccacctttgctgggtatgagatgtggtgggtccgcagggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgagagatccttatagttttgactactggggtcagggaaccctggtcaccgtctcgagc

SEQ ID NO: 1128 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtggttccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgaaagatccttatagttttgacaactggggtcagggaaccctggtcaccgtctcgagc

SEQ ID NO: 1129 - DNA, 348 bp, Artificial Sequence
  Description of Artificial Sequence: Synthetic polynucleotide
gaggtgcagctgttggagtctgggggaggcttggtagagcctggggggtccctgcgtctctcctgtgcagcctccggattcacctttgctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgaaagaaccttatagttttgaccaccggggtcagggaaccctggtcaccgtctcgagc

SEQ ID NO: 1130 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggatacacctttgctgggtatgagatgtggtgggtccgccaggctccagggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgaaagaaccttatagttttgaccaccggggtcagggaaccctggtcaccgtctcgagc

SEQ ID NO: 1131 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctccagggaagggtctagagcgggtctcagctattagtggtagtggtggtagcacatactacgcagactctgtgaagggccggttcaccatctcccgcgacaattccaagaacacgctgtatctgcaaatgaacagcctgcgtgccgaggataccgcggtatatcactgtgcgaaagaaccttatagttatgactactggggtcagggaaccctggtcaccgtctcgagc

SEQ ID NO: 1132 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtggttccgccaggctccagggaagggtctagagcgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgcgaaagatccttatagttttgacaactggggtcagggaaccctggtcaccgtctcgagc

SEQ ID NO: 1133 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctccagggaagggtctagagcgggtctcagctattagtggtagtggtggtagcacatactacgcagactctgtgaagggccggttcaccatctcccgcgacgattccaagaacacgctgtatctgcaaatgaacagcctgcgtgccgaggataccgcggtatattactgtgcgaaagaaccttatagttatgactactggggtcagggaaccctggtcaccgtctcgagc

SEQ ID NO: 1134 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctcccgggaagggtctagagcgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgaaagatccttatagttttgacaactggggtcagggaaccctggtcaccgtctcgagc

SEQ ID NO: 1135 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtgggtccgccaggctccagggaagggtctagagtgggtctcagctattagtggtagtggtggtagcacatactacgcagactctgtgaagggccggttcaccatctcccgcgacgattccaagaacacgctgtatctgcaaatgaacagcctgcgtgccgaggataccgcggtatatcactgtgcgaaagaaccttatagttatgactactggggtcagggaaccctggtcaccgtctcgagc

SEQ ID NO: 1136 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagatgtggtggttccgccaggctccagggaagggtctagagtgggtctcagctattagtggtagtggtggtagcacatactacgcagactccgtgaagggccggttcaccatctcccgcgacgattccaagaacacgctgtatctgcaaatgaacagcctgcgtgccgaggataccgcggtatattactgtgcgaaagatccttatagttttgacaactggggtcagggaaccctggtcaccgtctcgagc

SEQ ID NO: 1137 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagttgtggtgggtccgccaggccccagggaagggtctagagcgggtctcagctattagtggaagtggtggtagcacatactacgcagactccgtgaagggccggttcaccatctcccgcgacgattccaagaacacgctgtatctgcaaatgaacagcctgcgtgccgaggataccgcggtatattactgtgcgaaagatccttatagttttgactaccggggtcagggaaccctggtcaccgtctcgagc

SEQ ID NO: 1138 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgggtatgagttgtggtgggtccgccaggccccagggaagggtctagagcgggtctcagctattagtggaagtggtggtagcacatactacgcagactccgtgaagggccggttcaccatctcccgcgacgattccaagaacacgctgtatctgcaaatgaacagcctgcgtgccgaggataccgcggtatattactgtgcgagagatccttatagttttgactactggggtcagggaaccctggtcaccgtctcgagc

SEQ ID NO: 1139 - DNA, 360 bp, Artificial Sequence
  Description of Artificial Sequence: Synthetic polynucleotide
gaggtgcagctgttggagtctggggggggcttggtacagcctggggggtccctgcgtctctcctgtgcagcctccggattcacctttccgactgctgagatgctgtgggtccgcaaggctccagggaagggtctagagtgggtctcatctatttcggctagtggtggttctacatactacgcagactccgtgaagggccggttcaccatctcccgcgacaattccaagaacacgctgtatctgcaaatgaacagcctgcgtgccgaggacaccgcggtatattactgtgcgaaagagccggtgagttatgtggcgacgtttgactactggggtcagggaaccctggtcaccgtctcgagc

SEQ ID NO: 1140 - DNA, 360 bp, Artificial Sequence
  Description of Artificial Sequence: Synthetic polynucleotide
gaggtgcagctgttggtgtctgggggaggcttggtacagcctggggggtccctgcgtctctcctgtgcagcctccggattcacctttccgactgctgagatgttgtgggtccgccaggctccagggaagggtccagagtgggtctcatcaatttcggctagtggtggttctacatactatgcagactccgtgaagggccggttcaccatctcccgcgacaattccaagaacacgctgtatctgcaaatgaacagcctgcgtgccgaggacaccgcggtatattactgtgcgaaagagccggtgagttatgtggcgacgtttgactactggggtcagggaaccctggtcaccgtctcgagc

SEQ ID NO: 1141 - DNA, 360 bp, Artificial Sequence
  Description of Artificial Sequence: Synthetic polynucleotide
gaggtgcagctgttggagtctgggggaggcttggtacagcctggggggtccctgcgtctctcgtgtgcagcctccggattcacctttccgactgccgagatggtgtgggtccgcaaggctccagggatgggtctagagtgggtctcatctatttcggctagtggtggttatacatactacgcagactccgtgaagggccggttcaccatctcccgcgacaattccaagaacatgctgtatctgcaaatgaacagcctgcgtgccgaggacaccgcggtatattactgtgcgaaagagccggtgagttatgtggcgacgtttgactactggggtcagggagccctggtcaccgtcacgagc

SEQ ID NO: 1142 - DNA, 360 bp, Artificial Sequence
  Description of Artificial Sequence: Synthetic polynucleotide
gaggtgcagctgttggtgtctgggggaggcttggtacagcctggggggtccctgcgtctctcctgtgcagcctccggattcacctttccgactgctgagatggtgtgggtccgccaggctccagggaagggtctagagtgggtctcatctatttcggctagtggtggttctacatactacgcagactccgtgaagggccggttctccatctcccgcgacgattccaagaacacgctgtatctgcaaatgaacagcctgcgtgccgaggacaccgcggtatattactgtgcgaaagagccggtgagttatgtggcgacgtttgactactggggtcatggagccctggtcaccgtctcgagc

SEQ ID NO: 1143 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacatttccgactgctgagatgttgtgggtccgccaggctccagggaagggtctagagtgggtctcatctatttcggctagtggtggttctacatactacgcagactccgtgaagggccggttcaccatctcccgcgacaattccaagaacacgctgtatctgcaaatgaacagcctgcgagccgaggacaccgcggtatattactgtgcgaaagagccggtgagttatgtggcaacgtttgactactggggtcagggaaccctggtcaccgtctcgagc

SEQ ID NO: 1144 - DNA, 360 bp, Artificial Sequence
  Description of Artificial Sequence: Synthetic polynucleotide
gaggcgcagctgttggagtctgggggtggcttggtacagcctggggggtccctgcgtctctcctgtgcagcctccggattcacctttccgactgctgagatggtgtgggtccgccaggctccagggaagggtctagagtggatctcatctatttcggctagtggtggttctacatactacgcagactccgtgaagggccggttcaccatctcccgcgacaattccaagaacacgctgtatctgcaattgaacagcctgcgtgccgaggacaccgcggtatattactgtgcgaaagagccggtgagttatgtggcgacgtttgactactggggtcggggaaccctggtcaccgtctcgagc

SEQ ID NO: 1145 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacatttccgactgctgagatgttgtgggtccgccaggctccagggaagggtctagagtgggtctcatctatttcggctagtggtggttctacatactacgcagactccgtgaagggccggttcaccatctcccgcgacaattccaagagcacgctgtatctgcaaatgaacagcctgcgtgccgaggacaccgcggtatattactgtgcgaaagagccggtgagttatgtggcgacgtttgactactggggtccaggagccctggtcaccgtctcgagc

SEQ ID NO: 1146 - DNA, 360 bp, Artificial Sequence
  Description of Artificial Sequence: Synthetic polynucleotide
gaggtgcagctgttggagtccgggggaggcttggtacagcctggggggtccctgcgtctctcctgtgcagcctccggattcacctttccgactgctgagatgctgtgggtccgcaaggctccagggaagggtctagagtgggtctcatctatttcggctagtggtggttctacatactacgcagactccgtgaagggccggttcaccatctcccgcgacaattccaagaacacgctgtttctgcaaatgaacagcctgcgtgccgaggacaccgcggtatattactgtgccaaagagccggtgagttatgtggcgacgtttgactactggggtcagggaaccctggtcaccgtctcgagc

SEQ ID NO: 1147 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacatttccgactgctgagatgttgtgggtccgccaggctccagggaagggtctagagtgggtctcatctatttcggctagtggtggttctacatactacgcagactccgtgaagggccggttcaccatctcccgcgacaattccaagaacacgctgtatctgcaaatgaacagcctgcgtgccgaggacaccgcggtatattactgtgcgaaagagccggtgagttatgtggcgacgtttgactactggggtccaggagccctggtcaccgtctcgagc

SEQ ID NO: 1148 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccgactgctgagatgctgtgggtccgccaggctccagggaagggtctagagtgggtctcatctatttcggctagtggtggttctacatactacgcagactccgtgaagggccggttcaccatctcccgcgacaattccaagaacacgctgtatttgcaaatgaacagcctgcgtgccgaggacaccgcggtatattactgtgcgaaagagccggtgtattatgtggcgacgtttgactactggggtcagggaaccctggtcaccgtctcgagc

SEQ ID NO: 1149 - DNA, 360 bp, Artificial Sequence
  Description of Artificial Sequence: Synthetic polynucleotide
gaggtgcagctgttggagtccgggggaggcttggtacagcctggggggtccctgcgtctctcctgtgcagcctccggattcacctttccgactgctgagatgctgtgggtccgcaaggctccagggaagggtctagagtgggtctcatctatttcggctagtggtggttctacatactacgcagactccgtgaagggccggttcaccatctcccgcgacaattccaagaacacgctgtatctgcaaatgaacagcctgcgtgccgaggacgccgcggtatattactgtgcgaaagagccggtgagttatgtggcgacgtttgactactggggtcagggaaccctggtcaccgtctcgagc

SEQ ID NO: 1150 - DNA, 324 bp, Artificial Sequence
  Description of Artificial Sequence: Synthetic polynucleotide
aacatccagatgacccagtctccatcctccctgtctgcatctgtaggagaccgtgtcaccatcacttgccgggcaagtcattttattggtactctgttaacttggtaccagcataaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1151 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagcagaaaccacggaaagcccctaaactcctgatcacttatggttccttgttgcaaagtggggtcccatcacgtttcagtggcagtggatctgggacagatttcactctcaccatcagcagtctgcatcctgaagattttgctacgtactactgtggtcagggggtgctgtggcctccgacgttcggtcaagggaccaaggtggaaatcaaacgg

SEQ ID NO: 1152 - DNA, 324 bp, Artificial Sequence
  Description of Artificial Sequence: Synthetic polynucleotide
gacatccagatgacccagtctccgtcctccctgactgcatctgtaggagaccgtgtcaccatcacttgccgggcaagtcattttattggtactctgttatcttggtaccagcagaaaccagggaaagcccctaagctcctggtcacttatggttccttgttgcaaagtggggtcccatcacgtttcagtggcagtggatctgggacagatttcactctcaccatcagcaatctgcaacctgaagattttgctacgtactactgtggtcagggggtgctgtggcctcctacgttcggccaagggaccaaggtggaaaacatacgg

SEQ ID NO: 1153 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattgctactctgttatcttggtaccagcagaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctccgacgttcggccaagggaccaaggtggaaatcaaacgg

SEQ ID NO: 1154 - DNA, 324 bp, Artificial Sequence
  Description of Artificial Sequence: Synthetic polynucleotide
gacatccagatgacccagtctccatccttcctgtctgcatctgtaggagaccgtgtcaccatcacttgccgggcaagtcattttattgctactctgttatcttggtaccagcagaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctccgacgttcggccaagggaccaaggtggaaatcaaacgg

SEQ ID NO: 1155 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagcagaaaccagggaaagccactaagctcctgatcacttatggttccttgttgcaaagtggggtcccatcacgtttcagtggcagtggatctgggacagatttcactctcaccatcagcagtctgcaacctgaagactttgctacgtactactgtggtcagggggtgctgtggcccccgacgttcggccaggggaccaaggtggaaatcaaacgt

SEQ ID NO: 1156 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggttctctgttatcttggtaccagcataaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1157 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagcataaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1158 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagcataaaccagggaaagcccctaagctcctgatcacttatggttccatgttgcaaagtggggtcccatcacgtttcagtggcagtggatctgggacagatttcactctcaccatcagcagtctgcaacctgaagattttgcaacgtactactgtggtcagggggtgctgtggcctgcgacgttcggccaagggaccaaggtggaaatcaaacgg

SEQ ID NO: 1159 - DNA, 324 bp, Artificial Sequence
  Description of Artificial Sequence: Synthetic polynucleotide
gacatccagatgactcagtctccatcctccctgtctgcatctgtaggagaccgagtcaccatcacttgccgggcaagtcattttattggtactctgttatcctggtaccagcataaaccagggaaagcccctaagctcctgatcacctatggttccttgttgcaaagtggggtcccatcacgtttcagtggcagtggatctgggacagaattcactctcaccatcagcagtctgcaacctgaagattttgctacgtactactgtggtcagggagtgctgtggcctgcgacgttcggccaagggaccaaggtggaaatcaaacgg

SEQ ID NO: 1160 - DNA, 324 bp, Artificial Sequence
  Description of Artificial Sequence: Synthetic polynucleotide
gacatccagatgacccagtctccatcctccctgactgcatctgtaggagaccgtgtcaccatcacttgccgggcaagtcattttattggtactctgttatcttggtaccagcataaaccagggaaagcccctaagctcctgatcacttatggttccttgttgcaaagtggggtcccatcacgtttcagtggcagtggatctgggacagaattcactctcaccatcagcagtctgcaacctgaagattttgctacgtactactgtggtcagggggtgctgtggcctgcgacgttcggccaagggaccaaggtggaaatcaaacgg

SEQ ID NO: 1161 - DNA, 324 bp, Artificial Sequence
  Description of Artificial Sequence: Synthetic polynucleotide
aacatccagatgacccagtctccatcctccctgtctgcatctgtaggagaccgtgtcaccatcacttgccgggcaagtcattttattggtactctgttatcttggtaccagcataaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1162 - DNA, 324 bp, Artificial Sequence
  Description of Artificial Sequence: Synthetic polynucleotide
gacatccagatgacccagtctccatcctccctgtctgcatctgtaggagaccgtgtcaccatcaattgccgggcaagtcattttattggtactctgttatcttggtaccagcataaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1163 - DNA, 324 bp, Artificial Sequence
  Description of Artificial Sequence: Synthetic polynucleotide
gacatccagttgacccagtcaccatcctccctgtctgcatctgtaggagaccgtgtcaccatcacttgccgggcaagtcattttattggtactctgttatcttggtaccagcagaaaccagggaaagccactaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctccgacgttcggccaagggaccaaggtggaaatcaaacgg

SEQ ID NO: 1164 - DNA, 324 bp, Artificial Sequence
  Description of Artificial Sequence: Synthetic polynucleotide
gacatccagatgacacagtctccatcctccctgtatgcatctgtaggagaccgtgtcaccatcacttgccgggtaagtcattttattggtactctgttatcttggtaccagcagaaaccagggaaagcccctaagctcctgatcacttatggttccttgttgcaaagtggggtcccatcacgtttcagtggcagtggatctgggacagatttcactctcagcatcagcagtctgcaacctgaagattttgctacgtactactgtggtcagggggtgctgtggcccccgacgttcggacaagggaccaaggtggaaatcaaacag

SEQ ID NO: 1165 - DNA, 324 bp, Artificial Sequence
  Description of Artificial Sequence: Synthetic polynucleotide
gacattcagatgacccagtctccatcctccctgtctgcatctgtaggagaccgtgtcaccatcacttgccgggcaagtcattttattggtactctgttatcttggtaccagcagaaaccaaggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctccgacgttcggccaagggaccaaggtggaaatcaaacgg

SEQ ID NO: 1166 - DNA, 324 bp, Artificial Sequence
  Description of Artificial Sequence: Synthetic polynucleotide
gacatccagattatccagtctccatcctccctttctgcatctgtaggagaccgtgtcaccatcacttgccgggcaagtcattttattggtactctgttatcttggtaccagcagaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctccgacgttcggccaagggaccaaggtggaaatcaaacgg

SEQ ID NO: 1167 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagctgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1168 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagctgaaaccagggaaagccccaaagctcctgatcacttatggttcctggttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtagaaaacaaacgg

SEQ ID NO: 1169 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagcttaaaccagggaaagcccctaagctcctgatcacttatggttccttgttgcaacgtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1170 - DNA, 324 bp, Artificial Sequence
  Description of Artificial Sequence: Synthetic polynucleotide
gacatccagatgacccaggctccatcctccctgtctgcatctgtaggagaccgtgtcaccatcacttgccgggcaagtcattttattggtactctgttatcttggtaccagctgaaaccagggaaagcccctaagctcctgatcacttatggttccttgttgcagagtggggtcccatcacgtttcagtggtagtggatctgggacagatttcactctcaccatcagcagtctgcaacctgaagattttgctacgtactactgtggtcagggggtgctgtggcctgcgacgttcggccaagggaccaaggttgaaaacaaacgg

SEQ ID NO: 1171 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggttctctgttatcttggtaccagcagaaaccagggaaagccccaaagctcctgatcacttatggttccttgttgcaaagtggggtcccatcacgtttcagtggcagtggatctgggacagatttcgctctcaccatcagcagtctgcaacctgaagattttgctacgtactactgtggtcagggggtgctgtggcctgcgacgttcggccaagggaccaaggtggaaatcaaacgg

SEQ ID NO: 1172 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1173 - DNA, 324 bp, Artificial Sequence
  Description of Artificial Sequence: Synthetic polynucleotide
gacatcctgatgacccagtctccatcctccctgtctgcatctgtaggagaccgtgtcaccatcacttgccgggcaagtcattttattggtagtctgttatcttggtaccagcagaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1174 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctggtatcttggtaccagcagaaaccggggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgtacggccaagggaccaaggtggaaatcaaacgg

SEQ ID NO: 1175 - DNA, 324 bp, Artificial Sequence
  Description of Artificial Sequence: Synthetic polynucleotide
gacatccagatgacccagtctccatcctctctgtctgcatctgtaggagaccgtgtcaccatcacttgccgggcaagtcattttattggtactctggtatcttggtaccagcagaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgactttcggccaagggaccaaggtggaaaacaaacgg

SEQ ID NO: 1176 - DNA, 324 bp, Artificial Sequence
  Description of Artificial Sequence: Synthetic polynucleotide
gacatcaagatgacccagtctccatcctccctgtctgcatctgtaggagaccgtgtcaccatcacttgccgggcgagtcattttattggtactctggtatcttggtaccagcagaaaccagggaaagccccaaagctcctgatcacttatggttccatgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1177 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccaggcaagtcattttattggtactctggtatcctggtaccagcagaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcccgcgacgttcggccaagggaccaaggtggaaatcaaacgg

SEQ ID NO: 1178 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagcagaaaccagggaaagcccctaagctcctgatcacttatggttcctggttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1179 - DNA, 324 bp, Artificial Sequence
  Description of Artificial Sequence: Synthetic polynucleotide
gacatccagatgacccagtctccatcctccctgtctgcatctgttggagaccgtgtcaccatcacttgccgggcaagtcattttattggtactctgttatcttggtaccagctgaaaccagggaaagcccctaagctcctgatcacttatggttcctggttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggaccaaggtggaaatcaaacgg

SEQ ID NO: 1180 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtactctgttatcttggtaccagcagaaaccggggaaagcccctaagctcctgatcacttatggttccttgttgcaaagtggggtcccatcacgtttcagtggcagtggatttgggacagatttcactctcaccatcagcagtctgcaacctgaagattttgctacgtactactgtggtcaggaggtgctgtggcctgcgacgttcggccaagggactaaggtggaaatcaaacgg

SEQ ID NO: 1181 - DNA, 324 bp, Artificial Sequence
  Description of Artificial Sequence: Synthetic polynucleotide
gacatccagatgacccagtctccatcctccctgtctgcatctgtaggagaccgtgtctccatcacttgccgagcaagtcattttattggtactctgttatcttggtaccagcagaaaccagggaaagcccctaagctcctgatcacttatggttccttgttgcaaagtggggtcccatcacgtttcagtggcagtggatttgggacagatttcactctcaccatcagcagtctgcaacctgaagatcttgctacgtactactgtggtcaggaggtgctgtggcctgcgacgttcggccaagggaccaaggtggaaatcaaacgg

SEQ ID NO: 1182 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccaggcaagtcattttattggtactctgttatcttggtaccagcagaaaccagggaaagcccctaagctcctgatcacttatggttccttgttgcaaagtggggtcccatcacgtttcagtggcagtggatttgggacagatttcactctcaccatcagcagtctgcaacccgaagattttgctacgtactactgtggtcaggaggtgctgtggcctgcgacgttcggccaagggaccaaggtggaaatcaaacgg

SEQ ID NO: 1183 - DNA, 324 bp, Artificial Sequence
  Description of Artificial Sequence: Synthetic polynucleotide
gacatccagatgacccagtctccatcctccctgtctgcatcagtaggagaccgtgtcaccatcacttgccgggcaagtcattttattggtactctgttatcttggtaccagcagaaacctgggaaagcccctaagctcctgatcacttatggttccttgttgcaaagtggggtcccatcacgtttcagtggcagtggatttgggacagaattcactctcaccatcggcagtctgcaacctgaagattttgctacgtactactgtggtcagggggtgctgtggcctgcgacgttcggccaagggaccaaggtggaaatcaaacgg

SEQ ID NO: 1184 - DNA, 324 bp, Artificial Sequence
  Description of Artificial Sequence: Synthetic polynucleotide
gacatccagatgacccagtcaccatcctccctgtctgcatctgtaggagaccgtgtcaccatcacttgccgggcaagtcattttattggtactctgttatcttggtaccagcagaaaccagggaaagccactaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctccgacgttcggccaagggaccaaggtggaaatcaaacgg

SEQ ID NO: 1185 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcacttcattgccagtctgttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1186 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcatttcattgcccagctgttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1187 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcatttcattgcccagctgttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcagacgg

SEQ ID NO: 1188 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattacattgcctccctgttatcttggtaccaggtgaaaccagggaaagcccctaagctcctgatcacttatggttccttgttgcagagtggggccccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1189 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttgggcctcctacttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1190 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttggacgtcctacttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1191 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttggtcgtcctacttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1192 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttgggggtcctggttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1193 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttgggcgtcctggttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1194 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttggagctcctggttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1195 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattggattgcccagctgttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1196 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggttcgctcttacgctggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1197 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcatcggattgcccagctgttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1198 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattacattgcctccctgttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1199 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatccggttcggctccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1200 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttacaagtcctacttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1201 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttggggctcctacttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1202 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttatttgggggcccttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattctgctacgtactactgtggtcagggggtgctgtggcctgcgacgttcggccaagggacaacggtggaaatcaaacgg

SEQ ID NO: 1203 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattggattgccaccctgttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1204 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttatttgggggcccttatcttggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1205 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcattttattggtagcctcttaaactggtaccaggtgaaaccagggaaagcccctaagctcctgatcacttatggttccttgttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1206 - DNA, 324 bp, Artificial Sequence
  Description of Artificial Sequence: Synthetic polynucleotide
ggcatccagatgacccagtctccatcctccctgtctgcatctgtaggagaccgtgtcaccatcacttgccgggcaagtcattttattggtagtctgttatcttggtaccaggtgaaaccagggaaagcccctaagctcctgatcacttacgggtcctggttgcaaagtggggtcccatcacgtttcagtggcagtggatctgggacagatttcactctcaccatcagcagtctgcaacctgaagattttgctacgtactactgtggtcagggggtgctgtggcctgcgacgttcggccaagggacaacggtggaaatcaaacgg

SEQ ID NO: 1207 - protein, 5 aa, Artificial Sequence
  Description of Artificial Sequence: Synthetic peptide
GGGGS

SEQ ID NO: 1208 - protein, 15 aa, Artificial Sequence
  Description of Artificial Sequence: Synthetic peptide
GGGGSGGGGSGGGGS

SEQ ID NO: 1209 - protein, 25 aa, Artificial Sequence
  Description of Artificial Sequence: Synthetic peptide
GGGGSGGGGSGGGGSGGGGSGGGGS

SEQ ID NO: 1210 - protein, 227 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFQEWGQGTLVTVSSASTDIQMTQSPSSLSASVGDRVTITCRASRPIGTTLSWYQQKPGKAPKLLILWNSRLQSGVPSRFSGSGSGTDFTLTISSLQPEDFATYYCAQAGTHPTTFGQGTKVEIKR

SEQ ID NO: 1211 - protein, 227 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFQEWGQGTLVTVSSASTDIQMTQSPSSLSASVGDRVTITCRASRPIGTMLSWYQQKPGKAPKLLILAFSRLQSGVPSRFSGSGSGTDFTLTISSLQPEDFATYYCAQAGTHHTTFGQGTKVEIKR

SEQ ID NO: 1212 - protein, 227 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSSASTDIQMTQSPSSLSASVGDRVTITCRASRPIGTTLSWYQQKPGKAPKLLILWNSRLQSGVPSRFSGSGSGTDFTLTISSLQPEDFATYYCAQAGTHPTTFGQGTKVEIKR

SEQ ID NO: 1213 - protein, 227 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSSASTDIQMTQSPSSLSASVGDRVTITCRASRPIGTMLSWYQQKPGKAPKLLILAFSRLQSGVPSRFSGSGSGTDFTLTISSLQPEDFATYYCAQAGTHHTTFGQGTKVEIKR

SEQ ID NO: 1214 - protein, 230 aa, Artificial Sequence
  Description of Artificial Sequence: Synthetic polypeptide
DIQMTQSPSSLSASVGDRVTITCRASRPIGTTLSWYQQKPGKAPKLLILWNSRLQSGVPSRFSGSGSGTDFTLTISSLQPEDFATYYCAQAGTHPTTFGQGTKVEIKRTVAAPSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFQEWGQGTLVTVSS

SEQ ID NO: 1215 - protein, 230 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISSLQPEDFATYYCAQAGTHHTTFGQGTKVEIKRTVAAPSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFQEWGQGTLVTVSS

SEQ ID NO: 1216 - protein, 230 aa, Artificial Sequence
  Description of Artificial Sequence: Synthetic polypeptide
DIQMTQSPSSLSASVGDRVTITCRASRPIGTTLSWYQQKPGKAPKLLILWNSRLQSGVPSRFSGSGSGTDFTLTISSLQPEDFATYYCAQAGTHPTTFGQGTKVEIKRTVAAPSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSS

SEQ ID NO: 1217 - protein, 230 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISSLQPEDFATYYCAQAGTHHTTFGQGTKVEIKRTVAAPSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSS

SEQ ID NO: 1218 - protein, 230 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKRTVAAPSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFQEWGQGTLVTVSS

SEQ ID NO: 1219 - protein, 230 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISSLQPEDVATYYCAQAGTHPTTFGQGTKVEIKRTVAAPSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFQEWGQGTLVTVSS

SEQ ID NO: 1220 - protein, 230 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISSLQPEDFATYYCAQAGVHPTTFGQGTKVEIKRTVAAPSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFQEWGQGTLVTVSS

SEQ ID NO: 1221 - protein, 230 aa, Artificial Sequence
  Description of Artificial Sequence: Synthetic polypeptide
DIQMTQSPSSLSASVGDRVTITCRASRPIGTTLSWYQQKPGKAPKLLILWNSRLQSGVPSRFSGSGSGTDFTLTISSLQPEDFATYYCAQAGTHPTTFGQGTKVEIKRTVAAPSEVQLLESGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSS

SEQ ID NO: 1222 - protein, 227 aa, Artificial Sequence
  Description of Artificial Sequence: Synthetic polypeptide
EVQLLESGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSSASTDIQMTQSPSSLSASVGDRVTITCRASRPIGTTLSWYQQKPGKAPKLLILWNSRLQSGVPSRFSGSGSGTDFTLTISSLQPEDFATYYCAQAGTHPTTFGQGTKVEIKR

SEQ ID NO: 1223 - protein, 230 aa, Artificial Sequence
  Description of Artificial Sequence: Synthetic polypeptide
DIQMTQSPSSLSASVGDRVTITCRASQWIGSQLSWYQQKPGKAPKLLIMWRSSLQSGVPSRFSGSGSGTDFTLTISSLQPEDFATYYCAQGLRHPKTFGQGTKVEIKRTVAAPSEVQLLESGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSS

SEQ ID NO: 1224 - protein, 227 aa, Artificial Sequence
  Description of Artificial Sequence: Synthetic polypeptide
EVQLLESGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSSASTDIQMTQSPSSLSASVGDRVTITCRASQWIGSQLSWYQQKPGKAPKLLIMWRSSLQSGVPSRFSGSGSGTDFTLTISSLQPEDFATYYCAQGLRHPKTFGQGTKVEIKR

SEQ ID NO: 1225 - protein, 227 aa, Artificial Sequence
  Description of Artificial Sequence: Synthetic polypeptide
EVQLLASGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSSASTDIQMTQSPSSLSASVGDRVTITCRASRPIGTTLSWYQQKPGKAPKLLILWNSRLQSGVPSRFSGSGSGTDFTLTISSLQPEDFATYYCAQAGTHPTTFGQGTKVEIKR

SEQ ID NO: 1226 - protein, 227 aa, Artificial Sequence
  Description of Artificial Sequence: Synthetic polypeptide
EVQLLASGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSSASTDIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKR

SEQ ID NO: 1227 - protein, 230 aa, Artificial Sequence
  Description of Artificial Sequence: Synthetic polypeptide
DIQMTQSPSSLSASVGDRVTITCRASRPIGTTLSWYQQKPGKAPKLLILWNSRLQSGVPSRFSGSGSGTDFTLTISSLQPEDFATYYCAQAGTHPTTFGQGTKVEIKRTVAAPSEVQLLASGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSS

SEQ ID NO: 1228 - protein, 230 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKRTVAAPSEVQLLASGGGLVQPGGSLRLSCAASGFTFEEEEMIWVRQAPGKGLEWVSAISRNGYSTYYADSVKGRFTISRDNSKNTLYLQMNSLRAEDTAVYYCGKEPFRYDYWGQGTLVTVSS

SEQ ID NO: 1229 - protein, 227 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKRTVAEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSS

SEQ ID NO: 1230 - protein, 231 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKRASTSGPSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSS

SEQ ID NO: 1231 - protein, 229 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKRGGGGSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSS

SEQ ID NO: 1232 - protein, 239 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKRGGGGSGGGGSGGGGSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSS

SEQ ID NO: 1233 - protein, 249 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKRGGGGSGGGGSGGGGSGGGGSGGGGSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSS

SEQ ID NO: 1234 - protein, 227 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSSTVADIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKR

SEQ ID NO: 1235 - protein, 231 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSSASTSGPSDIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKR

SEQ ID NO: 1236 - protein, 229 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSSGGGGSDIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKR

SEQ ID NO: 1237 - protein, 239 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSSGGGGSGGGGSGGGGSDIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKR

SEQ ID NO: 1238 - protein, 249 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSSGGGGSGGGGSGGGGSGGGGSGGGGSDIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKR

SEQ ID NO: 1239 - protein, 230 aa, Artificial Sequence
  Description of Artificial Sequence: Synthetic polypeptide
DIQMTQSPSSLSASVGDRVTITCRASRPIGTMLSWYQQKPGKAPKLLILAFSRLQSGVPSRFSGSGSGTDFTLTISNLQPEDFATYYCAQAGTHPTTFGQGTKVEIKRTVAAPSEVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFYFHEWGQGTLVTVSS

SEQ ID NO: 1240 - DNA, 681 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcaggagtggggtcagggaaccctggtcaccgtctcgagcgctagcaccgacatccagatgacccagtctccatcctccctgtctgcatctgtaggagaccgtgtcaccatcacttgccgggcaagtcgtccgattgggacgacgttaagttggtaccagcagaaaccagggaaagcccctaagctcctgatcctttggaattcccgtttgcaaagtggggtcccatcacgtttcagtggcagtggatctgggacagatttcactctcaccatcagcagtctgcaacctgaagattttgctacgtactactgtgcgcaggctgggacgcatcctacgacgttcggccaagggaccaaggtggaaatcaaacgg

SEQ ID NO: 1241 - DNA, 681 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcaggagtggggtcagggaaccctggtcaccgtctcgagcgctagcaccgacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcagtctgcaacctgaagattttgctacgtactactgtgcgcaggctgggacgcatcatacgacgttcggccaagggaccaaggtggaaatcaaacgg

SEQ ID NO: 1242 - DNA, 681 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagcgctagcaccgacatccagatgacccagtctccatcctccctgtctgcatctgtaggagaccgtgtcaccatcacttgccgggcaagtcgtccgattgggacgacgttaagttggtaccagcagaaaccagggaaagcccctaagctcctgatcctttggaattcccgtttgcaaagtggggtcccatcacgtttcagtggcagtggatctgggacagatttcactctcaccatcagcagtctgcaacctgaagattttgctacgtactactgtgcgcaggctgggacgcatcctacgacgttcggccaagggaccaaggtggaaatcaaacgg

SEQ ID NO: 1243 - DNA, 681 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagcgctagcaccgacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcagtctgcaacctgaagattttgctacgtactactgtgcgcaggctgggacgcatcatacgacgttcggccaagggaccaaggtggaaatcaaacgg

SEQ ID NO: 1244 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgacgttaagttggtaccagcagaaaccagggaaagcccctaagctcctgatcctttggaattcccgtttgcaaagtggggtcccatcacgtttcagtggcagtggatctgggacagatttcactctcaccatcagcagtctgcaacctgaagattttgctacgtactactgtgcgcaggctgggacgcatcctacgacgttcggccaagggaccaaggtggaaatcaaacgtacggtggctgcaccatctgaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcaggagtggggtcagggaaccctggtcaccgtctccagc

SEQ ID NO: 1245 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcagtctgcaacctgaagattttgctacgtactactgtgcgcaggctgggacgcatcatacgacgttcggccaagggaccaaggtggaaatcaaacgtacggtggctgcaccatctgaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcaggagtggggtcagggaaccctggtcaccgtctccagc

SEQ ID NO: 1246 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgacgttaagttggtaccagcagaaaccagggaaagcccctaagctcctgatcctttggaattcccgtttgcaaagtggggtcccatcacgtttcagtggcagtggatctgggacagatttcactctcaccatcagcagtctgcaacctgaagattttgctacgtactactgtgcgcaggctgggacgcatcctacgacgttcggccaagggaccaaggtggaaatcaaacgtacggtggctgcaccatctgaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctccagc

SEQ ID NO: 1247 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcagtctgcaacctgaagattttgctacgtactactgtgcgcaggctgggacgcatcatacgacgttcggccaagggaccaaggtggaaatcaaacgtacggtggctgcaccatctgaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctccagc

SEQ ID NO: 1248 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacgtacggtggctgcaccatctgaggtgcagctgttggagtccgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcaggagtggggtcagggaaccctggtcaccgtctccagc

SEQ ID NO: 1249 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcagtctgcaacctgaagatgttgctacgtactactgtgcgcaggctgggacgcatcctacgacgttcggccaagggaccaaggtggaaatcaaacgtacggtggctgcaccatctgaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcaggagtggggtcagggaaccctggtcaccgtctccagc

SEQ ID NO: 1250 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcagtctgcaacctgaagattttgctacgtactactgtgcgcaggctggggtgcatcctacgacgttcggccaagggaccaaggtggaaatcaaacgtacggtggctgcaccatctgaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcaggagtggggtcagggaaccctggtcaccgtctccagc

SEQ ID NO: 1251 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgacgttaagttggtaccagcagaaaccagggaaagcccctaagctcctgatcctttggaattcccgtttgcaaagtggggtcccatcacgtttcagtggcagtggatctgggacagatttcactctcaccatcagcagtctgcaacctgaagattttgctacgtactactgtgcgcaggctgggacgcatcctacgacgttcggccaagggaccaaggtggaaatcaaacgtacggtggctgcaccatctgaggtgcagctgttggagtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctccagc

SEQ ID NO: 1252 - DNA, 681 bp, Artificial Sequence
  Description of Artificial Sequence: Synthetic polynucleotide
gaggtgcagctgttggagtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagcgctagcaccgacatccagatgacccagtctccatcctccctgtctgcatctgtaggagaccgtgtcaccatcacttgccgggcaagtcgtccgattgggacgacgttaagttggtaccagcagaaaccagggaaagcccctaagctcctgatcctttggaattcccgtttgcaaagtggggtcccatcacgtttcagtggcagtggatctgggacagatttcactctcaccatcagcagtctgcaacctgaagattttgctacgtactactgtgcgcaggctgggacgcatcctacgacgttcggccaagggaccaaggtggaaatcaaacgg

SEQ ID NO: 1253 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtggattgggtctcagttatcttggtaccagcagaaaccagggaaagcccctaagctcctgatcatgtggcgttcctcgttgcaaagtggggtcccatcacgtttcagtggcagtggatctgggacagatttcactctcaccatcagcagtctgcaacctgaagattttgctacgtactactgtgctcagggtttgaggcatcctaagacgttcggccaagggaccaaggtggaaatcaaacgtacggtggctgcaccatctgaggtgcagctgttggagtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctccagc

SEQ ID NO: 1254 - DNA, 681 bp, Artificial Sequence
  Description of Artificial Sequence: Synthetic polynucleotide
gaggtgcagctgttggagtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagcgctagcaccgacatccagatgacccagtctccatcctccctgtctgcatctgtaggagaccgtgtcaccatcacttgccgggcaagtcagtggattgggtctcagttatcttggtaccagcagaaaccagggaaagcccctaagctcctgatcatgtggcgttcctcgttgcaaagtggggtcccatcacgtttcagtggcagtggatctgggacagatttcactctcaccatcagcagtctgcaacctgaagattttgctacgtactactgtgctcagggtttgaggcatcctaagacgttcggccaagggaccaaggtggaaatcaaacgg

SEQ ID NO: 1255 - DNA, 681 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagcgcttcaaccgacatccagatgacccagtctccatcctccctgtctgcatctgtaggagaccgtgtcaccatcacttgccgggcaagtcgtccgattgggacgacgttaagttggtaccagcagaaaccagggaaagcccctaagctcctgatcctttggaattcccgtttgcaaagtggggtcccatcacgtttcagtggcagtggatctgggacagatttcactctcaccatcagcagtctgcaacctgaagattttgctacgtactactgtgcgcaggctgggacgcatcctacgacgttcggccaagggaccaaggtggaaatcaaacgg

SEQ ID NO: 1256 - DNA, 681 bp, Artificial Sequence
  Description of Artificial Sequence: Synthetic polynucleotide
gaggtgcagctgttggcgtctgggggaggcttggtacagcctggggggtccctgcgtctctcctgcgcagcctccggattcacctttgaggaggaggagatgatttgggtccgccaggccccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctcgagcgcttcaaccgacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacgg

SEQ ID NO: 1257 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgacgttaagttggtaccagcagaaaccagggaaagcccctaagctcctgatcctttggaattcccgtttgcaaagtggggtcccatcacgtttcagtggcagtggatctgggacagatttcactctcaccatcagcagtctgcaacctgaagattttgctacgtactactgtgcgcaggctgggacgcatcctacgacgttcggccaagggaccaaggtggaaatcaaacggaccgtggcggcgccgagtgaggtgcagctgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctccagc

SEQ ID NO: 1258 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacggaccgtggcggcgccgagtgaggtgcaactgttggcgtctgggggaggcttggtacagcctggggggtccctgcgtctctcctgcgcagcctccggattcacctttgaggaggaggagatgatttgggtccgccaggctccagggaagggtctagagtgggtctcagctattagtaggaacggttacagcacatactacgcagactccgtgaagggccggttcaccatctcccgcgacaattccaagaacacgctgtatctgcaaatgaacagcctgcgtgccgaggataccgcggtatattactgtgggaaagagccgtttcgttatgactactggggtcagggaaccctggtcaccgtctccagc

SEQ ID NO: 1259 - DNA, 681 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacgtacggtggcggaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctccagc

SEQ ID NO: 1260 - DNA, 693 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacgggctagcacctcaggtccatcggaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctccagc

SEQ ID NO: 1261 - DNA, 687 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacggggtggaggtggctctgaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctccagc

SEQ ID NO: 1262 - DNA, 717 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacggggtggaggtggctctggaggtggcggtagcggcggaggcggttcagaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctccagc

SEQ ID NO: 1263 - DNA, 747 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacggggtggaggtggctctggaggtggcggtagcggcggtggcggttcaggtggcggaggttctggaggcggtggatctgaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctccagc

SEQ ID NO: 1264 - DNA, 681 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtttcgagcacggtggcggacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacgg

SEQ ID NO: 1265 - DNA, 693 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagcgctagcacctcaggtccatcggacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacgg

SEQ ID NO: 1266 - DNA, 687 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagcggtggaggcggctctgacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacgg

SEQ ID NO: 1267 - DNA, 717 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagcggtggaggtggctctggaggtggcggtagcggcggtggcggttcagacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacgg

SEQ ID NO: 1268 - DNA, 747 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctcgagcggtggaggtggctctggaggtggcggtagcggcggtggcggttcaggtggcggaggttctggaggcggtggatctgacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacgg

SEQ ID NO: 1269 - DNA, 690 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcgtccgattgggacgatgttaagttggtaccagcagaaaccagggaaagcccctaagctcctgatccttgctttttcccgtttgcaaagtggggtcccatcacgtttcagtggcagtggatctgggacagatttcactctcaccatcagcaatctgcaacctgaagattttgctacgtactactgcgcgcaggctgggacgcatcctacgacgttcggccaagggaccaaggtggaaatcaaacggaccgtagcggcgccgagtgaggtgcagctgttggagtctgggggaggcttggtacagcctggggggtccctgcgtctctcctgtgcagcctccggattcacctttcgggattatgagatgtggtgggtccgccaggctccagggaagggtctagagcgggtctcagctattaatccgcagggtacgcgtacatactacgcagactccgtgaagggccggttcaccatctcccgcgacaattccaagaacacgctgtatctgcaaatgaacagcctgcgtgccgaggacaccgcggtatattactgtgcgaaacttccgttttactttcacgagtggggtcagggaaccctggtcaccgtctccagc

SEQ ID NO: 1270 - protein, 44 aa, Artificial Sequence
  Description of Artificial Sequence: Synthetic polypeptide
CSPGFGVKQIATGVSDTICEPCPVGFFSNVSSAFEKCHPWTSCE

SEQ ID NO: 1271 - protein, 44 aa, Artificial Sequence
  Description of Artificial Sequence: Synthetic polypeptide
CSPGYRVKEACGELTGTVCEPCPPGTYIAHLNGLSKCLQCQMCD

SEQ ID NO: 1272 - protein, 44 aa, Artificial Sequence
  Description of Artificial Sequence: Synthetic polypeptide
CQPGQKLVSDCTEFTETECLPCGESEFLDTWNRETHCHQHKYCD

SEQ ID NO: 1273 - protein, 19 aa, Artificial Sequence
  Description of Artificial Sequence: Synthetic peptide
DPGGGGGRLVPRGFGTGDP

SEQ ID NO: 1274 - protein, 5 aa, Artificial Sequence
  Description of Artificial Sequence: Synthetic peptide
  MOD_RES (1)..(1): Asp or Gly
  MOD_RES (4)..(4): Met or Leu
XYEXW

SEQ ID NO: 1275 - protein, 17 aa, Artificial Sequence
  Description of Artificial Sequence: Synthetic peptide
  MOD_RES (5)..(5): Gln, Tyr, Pro, Trp or Ala
  MOD_RES (7)..(7): Thr, Ser, Asn, Gly, Met or Gln
  MOD_RES (8)..(8): Arg, Leu, Tyr, His or Phe
  MOD_RES (16)..(16): Lys or Met
AINPXGXXTYYADSVXG

SEQ ID NO: 1276 - protein, 7 aa, Artificial Sequence
  Description of Artificial Sequence: Synthetic peptide
  MOD_RES (1)..(1): Leu or Pro
  MOD_RES (3)..(3): Phe, Gln, Thr or Met
  MOD_RES (4)..(4): Tyr, Pro, Leu, Thr, Ile, Phe or Met
  MOD_RES (6)..(6): Gln, His, Asp, Ser, Lys, Glu or Gly
  MOD_RES (7)..(7): Glu, Asp or Tyr
XPXXFXX

SEQ ID NO: 1277 - protein, 30 aa, Artificial Sequence
  Description of Artificial Sequence: Synthetic polypeptide
  MOD_RES (18)..(18): Leu or Arg
  MOD_RES (30)..(30): Arg or Ala
EVQLLESGGGLVQPGGSXRLSCAASGFTFX

SEQ ID NO: 1278 - protein, 14 aa, Artificial Sequence
  Description of Artificial Sequence: Synthetic peptide
  MOD_RES (4)..(4): Gln or Arg
  MOD_RES (8)..(8): Lys or Arg
  MOD_RES (9)..(9): Gly or Val
WVRXAPGXXLERVS

SEQ ID NO: 1279 - protein, 32 aa, Artificial Sequence
  Description of Artificial Sequence: Synthetic polypeptide
  MOD_RES (12)..(12): Thr or Met
  MOD_RES (23)..(23): Glu or Asp
  MOD_RES (26)..(26): Ala or Ser
  MOD_RES (29)..(29): Tyr or His
  MOD_RES (31)..(31): Ala or Thr
RFTISRDNSKNXLYLQMNSLRAXDTXVYXCXK

SEQ ID NO: 1280 - protein, 11 aa, Artificial Sequence
  Description of Artificial Sequence: Synthetic peptide
  MOD_RES (1)..(1): Trp or Arg
  MOD_RES (3)..(3): Gln or Pro
  MOD_RES (11)..(11): Ser or Asn
XGXGTLVTVSX

SEQ ID NO: 1281 - protein, 116 aa, Artificial Sequence
  Description of Artificial Sequence: Synthetic polypeptide
  MOD_RES (13)..(13): Gln or Arg
  MOD_RES (99)..(99): Glu or Gly
  MOD_RES (101)..(101): Ala, Leu or Glu
  MOD_RES (102)..(102): Phe or Tyr
  MOD_RES (106)..(106): Trp or Arg
EVQLLESGGGLVXPGGSLRLSCAASGFTFEWYEMQWVRRAPGKGLEWVSAISGDGYRTYYADSVKGRFTISRDNSKNTLYLQMNSLRAEDTAVYYCAKXLXXFDYXGRGTLVTVSS

SEQ ID NO: 1282 - protein, 116 aa, Artificial Sequence
  Description of Artificial Sequence: Synthetic polypeptide
  MOD_RES (28)..(28): Thr or Pro
  MOD_RES (50)..(50): Ala or Ser
  MOD_RES (53)..(53): Arg or Gly
  MOD_RES (54)..(54): Arg, Ser, Asn, Gln, Gly, His or Leu
  MOD_RES (56)..(56): Tyr, Phe, Trp or Gly
  MOD_RES (57)..(57): Ser or Gly
  MOD_RES (102)..(102): Arg, Met or Pro
EVQLLASGGGLVQPGGSLRLSCAASGFXFEEEEMIWVRQAPGKGLEWVSXISXXGXXTYYADSVKGRFTISRDNSKNTLYLQMNSLRAEDTAVYYCGKEPFXYDYWGQGTLVTVSS

SEQ ID NO: 1283 - protein, 118 aa, Artificial Sequence
  Description of Artificial Sequence: Synthetic polypeptide
  MOD_RES (36)..(36): Met or Leu
  MOD_RES (39)..(39): Val or Phe
  MOD_RES (76)..(76): Asp or Asn
  MOD_RES (77)..(77): Ser or Thr
  MOD_RES (97)..(97): Tyr or His
  MOD_RES (100)..(100): Lys or Arg
  MOD_RES (101)..(101): Asp or Glu
  MOD_RES (105)..(105): Tyr or Phe
  MOD_RES (108)..(108): Trp or Arg
  MOD_RES (109)..(109): Gly or Arg
  MOD_RES (110)..(110): Gln or His
EVQLLESGGGLVQPGGSLRLSCAASGFTFAGTRYEXWWXRQAPGKGLERVSAISGSGGSTYYADSVKGRFTISRDXXKNTLYLQMNSLRAEDTAVYXCAXXPYSXDYXXXGTLVTVSS

SEQ ID NO: 1284 - protein, 232 aa, Artificial Sequence
  Description of Artificial Sequence: Synthetic polypeptide
EPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1285 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1286 - protein, 351 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFRFSDRGQGTLVTVSSASTEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1287 - protein, 348 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFRFSDRGQGTLVTVSSASTESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

What is claimed is:

1. An antibody polypeptide comprising a first variable domain, wherein said antibody polypeptide specifically binds human CD40, wherein the first variable domain comprises:
   (a) a CDR1 region comprising the amino acid sequence of the CDR1 region of BMS3h-56-269 (amino acids 31 to 35 of SEQ ID NO: 417),
   (b) a CDR2 region comprising the amino acid sequence of the CDR2 region of BMS3h-56-269 (amino acids 50 to 66 of SEQ ID NO: 417), and
   (c) a CDR3 region comprising the amino acid sequence of the CDR3 region of BMS3h-56-269 (amino acids 99 to 105 of SEQ ID NO: 417).

2. The antibody polypeptide of claim 1, wherein the first variable domain comprises the amino acid sequence of BMS3h-56-269 (SEQ ID NO: 417).

3. The antibody polypeptide of claim 1, wherein the amino acid sequence of the first variable domain is set forth in SEQ ID NO: 417.

4. The antibody polypeptide of claim 1, wherein the antibody polypeptide is a domain antibody (dAb).

5. The antibody polypeptide of claim 1, wherein the antibody polypeptide is a fusion polypeptide comprising the first variable domain and an Fc domain.

6. The antibody polypeptide of claim 5, wherein the antibody polypeptide comprises the amino acid sequence of the BMS3h-56-269-IgG1*Fc fusion polypeptide (SEQ ID NO: 1286).

7. The antibody polypeptide of claim 5, wherein the antibody polypeptide comprises the amino acid sequence of the BMS3h-56-269-IgG4 Fc fusion polypeptide (SEQ ID NO: 1287).

8. The antibody polypeptide of claim 1, wherein the antibody polypeptide further comprises a second variable domain that specifically binds a second antigen, wherein the second antigen is an antigen other than human CD40.

9. The antibody polypeptide of claim 5, wherein the amino acid sequence of the antibody polypeptide is set forth in SEQ ID NO: 1286.

10. The antibody polypeptide of claim 5, wherein the amino acid sequence of the antibody polypeptide is set forth in SEQ ID NO: 1287.

11. A pharmaceutical composition comprising a therapeutically-effective amount of the antibody polypeptide of claim 1 and a pharmaceutically acceptable carrier.

12. The pharmaceutical composition of claim 11, further comprising an immunosuppressive/immunomodulatory and/or anti-inflammatory agent.

13. The pharmaceutical composition of claim 11, wherein the first variable domain of the antibody polypeptide comprises the amino acid sequence of SEQ ID NO: 417.

14. The pharmaceutical composition of claim 11, wherein the amino acid sequence of the antibody polypeptide is set forth in SEQ ID NO: 1286.

15. The pharmaceutical composition of claim 11, wherein the amino acid sequence of the antibody polypeptide is set forth in SEQ ID NO: 1287.

* * * * *